United States Patent 12,642,819 (COMPOSITIONS AND METHODS FOR TREATING INFLAMMATORY BOWEL DISEASE) - sequence listing, part 102

SEQ ID NO: 52 - DNA, 3915225 bp, Roseburia sp. (residues 1,957,614-3,915,225 of 3,915,225)
  modified_base (394442)..(394540): a, c, t, g, unknown or other
  modified_base (663594)..(663692): a, c, t, g, unknown or other
  modified_base (739895)..(739992): a, c, t, g, unknown or other
  modified_base (882574)..(882672): a, c, t, g, unknown or other
  modified_base (2361847)..(2361943): a, c, t, g, unknown or other
  modified_base (2527504)..(2527600): a, c, t, g, unknown or other
ggagaaacagatttcgaaaagttaaaaactttagcgccatgtaccctgtgatacagctttcgcggaagcaatgtgcgaatgtgatacagctttcgctgcaccacaagggttaacgaggattcaggtgatcgaagattcggcggatgcctgaacgcaggaatggggctgcgcatacgaatcacaaacaggatggtaacatccgaacaaaggattcgtaccccgatggagccaattgcatgagaatttgcttacgcgaagcaattggcatatgtgataacacttacgtgttaccacataatgcacaatgaaaaatattctgatgaacgaaaacaatatcgggatcataaaattatatgagaaaaaggagatttcaattatgtgtggaattattggatttacaggtaaattaaaagcccaggatgtcttattgacaggacttgcaagccttgagtaccgtggatatgacagtgcgggaattgcatactttaaagataccggaaaaatttcacttcggaaaactgtcggaaaagtaaaagatcttcgtgccatctgcgatgatgataacaattctacgtgtggaatcggccacacccgctgggcaacccatggtggcgttaccaatgccaatgcacaccctcataaggtcggacaggttgcattaatccacaatggtatcatcgagaactatcatgatctcgccaccaaatacgctctgacggatgaactgatttccgagacggataccgaagttgccgccgcattgatcaataaactctacgaaggagatccaaaagaagctctgcgcaaagcagtagccgaaattgaaggttcctttgccttctgcgttctgttcaaggatcatccgggtgaaatttatgcggtaagaaatgtcagccctatggttgcaacatactgtgatgacggtgcttttattgcatctgacctgactgcttttatcgcatacaacaagcgttatttcatcgtgccggaatatcatattttaactatgactgcggacggcattacgttagaagatttagacggtcattccgtagaaccggaatatatggaagtaaactgggatgttaccgcagcccagaaagatggttatccgcatttcatgatcaaagaaattcatgaacagccggctgccatcacaagaaccattaccccacgtatcaaagatatgcttccggatttttcggaagatgccattgcggattccttctttgaaaatgtaagcgacattacgatcgttgcctgtggtactgcaatgtacgcgggaatggtaggaaaaaccatgatccagaaccgcctgcatattccggttaccgtggcaatcgcatcggagttccgctatgaagaaccggtaatcaatgaaaaatccatggtgatcgttgtatcccagtccggagaaaccattgatactttggaagctcttcgccttgcaaataaatatacaaagaaaacactgtctattgtaaatgtaaaaggctccagcattgcacgtgaaagcagctatgtattatatacacatgccggtccggaaatcgctgttgcaagtacaaaagcatacaccgttcaggttgcttctttttacctgcttgcatgcaaacttgccatgaaacagcaaaagatttctgtcgaagaagcacgtacatttattggaacactgcaggaaattccaaattacatcgaggaagttcttgcacaggctcctgatattgaacagctgaccaaacgcatgatcaatgccaacaacgcgttctttatcggccgtggactcgattataccctttgcatggaaggtgctttgaaattaaaggaaatttcttatattcatgccgaagcctatgctgccggtgaattaaaacacggaaccattgctctggtcagtgaaggggttcctgtcattgccgctgctacccagaaacatgtatacagcaaagttatttccaatatccgggaagtaaaagcccgtggtgcttatgtcattcttttgtccaaagacaaagaaatcacagatccttctatctgtgatgtacacatcaatcttccggatgtatccgacgaatttacgatttttgaatctgttgtaattttccagctgattgcatattacacatccgttggaaaaggcttaaatccggatcagccacgtaacctggcaaaatctgtaacggtagaataagaaaaaactgtcgcgcgaaaattcgtgcgacagtttttttgacatagagcctttctaaaacttttgaaggcaaaaaaagaaccccagaagcttactaaaagcctctgaggttgcccctgccaaggattctctcacccatgtaccggaatccttgtatcgtcggcgcgacaggatttgaacctgcgacctctgcgtcccgaacgcagcgctctaccaagctgagccacgcgccgtttcaactgcccaattatagtaacacattctccggtgtttgtctagtgaatttttttaatttatggtacaatacaaaaaaagaacggagaagaacaatgaaacatactgctttgattacaggtgcatcccgtggaatcggtgcagccctggcatgtcgatttgccgctgaaggctatcatctggctctttgctgccataactcttatgaaacgctgcaggcacttgccacaaaacttgaaacaacctactccatacaggtgctttgcttccgtggtgatgtaggagactatacttttatctgtgacatggtgcaaaaaacactggataccttcggccagattgatgtgttaatcaacaatgccggcatctcttatatcggtctgctcaccgacatggatattaccgactggaaccggatagttgcgacaaacctcacatccgtcttttccacatgcagacaggtcatcccctccatggttcatgccaaatccggacatatcatcaatatttcttctgtatggggaaatgtcggagcttcctgcgaagttgcctattctgcatgcaaaggcgggatcaattcccttacacgcgctttgggcaaagaacttgcccctagcaatatccaggtaaatgccatcgcctgtggggtaatcgatacggatatgaaccgttgtttctccgaggaagaacgctctgcactcatcgaagaaattcctgccggccgtatgggatccccggaagaagttgcttcactggcatattctcttgccacagcaagcagttacctgaatggacagattctcaccttagacggcggatggatttaatttcttatctttttggaaatctttttccatttatttaagaattaaaacgcaatacgcgttttctctgttttttatatcaactttctataaaatcatttgtatgaaaacgaatgataaaaataaatacaaagattttggtgaccgtctgagtctgattatgtataaacaaaatatttccaatatccagctggcaaatgcaatgtttgtttcgccgtctacgatcagcggataccgtaccggtcgtcgttctccgaccgttgcggatcttgcagccatcgtgcagattctgaatgtttctgcagattacctcatcggaaccagtgaaattacaaccagacccgataccaccgaaaaatagagttgagcacgccctgtttccagagcggtgcccaactcttttttataaatcatgttctgccagtaaaattaccgtagaacgttccggaacacgcacacgtgtctgatctccctgtgtctgagcttcaaaatctgccccatcctggtattcacagaaagtatttactacaagtttccaatgataagactccggcaacgaaggcaggcgcatctccaaaggcccccaatacgcattcattccgtaaaagatcatatcatcatccgtatcatcggcatttcttcccgcatacatgattccaattaaatgtgtattatagtccgtataattccggttcggctctccgttatggatacttacggaaggtaacccgcagactgccggctttgtatcccttcgcagaatcggatgctttgcacggaaatggatcataaaacgggcaaaatcatgaatctcctgaaattcttccagtctgttccagtccagccaggaaataatattatcctgacagtatgcgttgttatttccatactgcgtattacaaaattcatcccctgcaaaaaacatagccggtccacggctgcataacaacgcggcaaatgcattttttacaagcctgcgccgcaggcccataaccgccggatcatccgtctcaccttccaccccgcagttccagctcaggccgttgttatccccgtccgtattgttccatccgtttttctcattatgcttttcattatacgaatacagatcatacaacgtgaacccatcatgacaggtcagaaaattgacggatgcactatatccgcggcttgccggatcatacatgtcggaggatccggtgatacgtgtaattgcacgccctgcgacgccactgtcgccctttaaaaagcttctcatatcatcacggtatcttccgttccattcggcccagcggttccaggacggaaaacttccaacctgatacaagccacccgcatcccaggcttctgcgatcagcttcatatcccccagaatagagtcaaatgcaagggcttccagaatcggcggattctccatcggtgcaccattctgatctcttcccagaatcgatgccagatcaaaccggaatccatccacccggtactctactgcccagtgccgcagacagtctgtaataaaccgccgtaccaccggatggttgcagtttaagacattgccacagccgctgaaattgtaataatatccatccggtgtaagcatataataaatattgttatcaatccccttaaagcaaaaacatggaccgtcttcatttccctctgccgtatggttgaataccacatcaagaatgacttcaattccattttctttcagttcgcggatcagacgctttaattcatcaccctcatgattatgctcctgatgaaatgcataacttgtattcggggcaaaaaaggaaaccgtattatagccccagtaattgtacaactgcacgccatccaccacacgggcactttccatttcatcaaattcaaaaatcggcatgagttctaccgcattgattcccagatctttcaaatacggaattttctgtcgcagaccttcaaatgttcccccaccttttacaccggaggacgcatctttggtaaatcccctgacatgcatctcatagatcaccagatcttcaaatttgtaattcagattccgataccgcccccagtcaaaatcactttgcaccacacgggctttatagacaaaatcctttccgccttccggtttttctccccagtttctctgaccggtaacagctttcgcatatggatcaagaagcgtatgttttctgttaaacagtaaccctctcgcctgatcggcaggaccgtccatctgataggcatactcaaaatcctctgcttttaagccaaaaacaaggatagaatacgtatttccaattttataactttccggaatgcggattcttgcatacggttcctgtgccgccggccggaataacagcaggacacagctcgtagctccatgggagcttacggtaaaacttaccccttcctctgtctgatatgcaccattcatctgataaaatcccggacgtacatcaaatccaccgatattatcgagtggatgaatgacttccccgagactttccatttcttcgtctatcggccagcttttctgttttgacggataattccaaaaacttgcattcatgtgctgattcctcttatcattattatttacttgccacataaaattatagtatccccctactcttccctgatgattaccctgccatttgcgtcaaatccgattttactgtacttttccgaatactcattcatatgatcaataatcgtctgttttctgtcgccttttgctatggcaggctgaaaattatttctttctgatgtggaagaaatgctgcatggtatcatatcggctgatatatctgtctgcagtaccccatccacaaaggtaaaggtctgttcatagatcgccgtatctttgtcttttggattcctgttccccccaaagcagaaatttccaagactgtagcagatcatttttccgttgtataattccattccctgcaatacatgaggatgtgtaccgaccagcagatctgctccccagtcaatcacctggtgtgccagcttctgctgataatcattcggataatgatccccctctatcccccagtggcaacaggcaattaccagatccgctccttcttcccgaagtttagcaatcccatcccggatataattggcatgttttctgcagacaactggcttgcggagacaattccgattttgataccatccttcgtggtataggtatccacatgatcattgaatccgaagataatccctgctttatttaacacttctctggtatcatcaagtccctgctgcccataatcaaacgtatgattatttcccagacttgccccctccacagaactgtctgtcataataccaacatactccggttttccttttaagttccacgttttttccacacgctcggtcgcatttgacaacacacattccagattgatcagtgtaaaatcatcctgctcaaaaatacttctgacatttttaaaaaaataatcctgcccgtatttatcatagtattcatgaaaggaacctgcatacccatgcgtctgtgttgcccccagcgtacagtcacctgtcgccgtaatttttaccgtctgtatcaccggttcctgctgcgtttcagttgcagtcccggtttccgtttcttccagcgtacccggttcttccgtcatctgtgtctccgtgattttttccgtagaagagggcaaagccgatgacgttgctgcaggagaagaacatcccgtcagcaaaaatcctgccattaggattggcaatatccattttttcatacgttttcagactcctctttcacaagaatatccaccgtgtgaccgcttgcacccataagatccatccgttcacaggttgccagatgatactgcagaaacgcatcaaactcttcttccgtcagcgcatttaaaaacggacgcatataatttgctgcaccgtctgccgctatgatctgccggcgcctgacctctacctgccggtccaatgcttcaatatcttccagacgaaccatggaatacagaggattggcttttgaagtacagtgataatcctctgtgagcattccctccttaagcgcctccagaatatgtttttccttaaacgcatacgtgataacggaaaattcattcataatatacgccacgagaatcctgcctccgggttttgtcaccctcactgcctcccgcagcgcagcaagcttgtccttttcctcatgcagatgatacatcggcccaaacaacagggttacgtcaaaggaatcatcggaaaattttttcagattcattgcatttccctgatatgcatgcacgcctgcacccttctgtttcaagcgtcccagattatgctttaccagttccacggccgtcacatcgaacccttcctgtgccagcggtacgctgtatcgtccggttcccgccccgatatcaaggatatgaatttcctcttttgcatgttctttcacaatttcatccagacactgatggatataatgcatacttgtcacaaattccaccctgccgtgtcggctgtccagacgcttctcttcattaaatttattataataggcttctaagtctgtcatattttaatactaacacattttctttaaaatttcactcacaatcgctgatgcgacatccgctttgctcattatttccagttccctgcagtcatctgccgtaatcagcgtcaccacattggtatctgtaccaaatccggctccggctaccttcaggttattcgccacaatcatatctgcattcttttttgcaagttttgcacgggaattctccagcatatgttccgtctccatggaaaatccacacagaaactgtcccggttttttgtgcgcgcccagatacgaaaggatatcttccgtgcgttccatcataagagtggcattcccgtcttttttcttgactttctcatcaaccgggtgatccggacggtaatccgccacggctgccgctttgataataatatcctgttgctctgcggtctcctttacggctgctgccatatccgcggcagatacaaccggaacgacctttacaaacggcggcggagtgattgccaccggtcccgtgatcagcgtcacttccgcgccacggcgcatgcagttttccgcaattgcatagcccatttttccggtagagtgattcgtaatataacgcaccggatcaatcttctcctgtgtcggtcctgctgtgaccatcactttctttccaaccatgtccttttcgcaggcaagatctttcataatataagaaaacagtgtttccggctccggcatctttccggctccggtatccccgcaggcaagataaccactcgccggatcaatgatatgaaacccataatgctccagctttttgatgttatcctgcacgatcggattttcaaacatattggtattcatggcaggggaaacatacttcgggcattttgccgcaagaatcgttgttgtcagcatatcatctgcgattccgtttgccatcttgccgatcacattggcagaagccggtgctaccataaaaatatctgcacgctttgccagtgccacatgctcgacattgaactggaaattccggtcaaacgtatcgaccagacacttgttgcttgtgagcgtctcaaacgtgataggattaataaaattggttgcattttccgtcatgatcacatgcacatccgcatgctgcttgacgagcgcacttgccagataggcgattttataggcagcgatacttccggtcacgccgagtaccacacattttccttttaacattgtctcttactcctttgcagaaaaaatcacatcttctgctattttatcacactttttccctaaaacaattgaatttttgtcatctgttccagtatggaatctttgacagaatcgttcagatatgctggatttaattttctttttgcatatgcaaggtaagaaccatttgtctcttcaatcaaaactgccgtaaaaaaccgctcccagctaaaatatgttttgctttccacatattcccacggcttttccagcacctgatctgcccatttgctttttactacttttgcctttaatatcagccattcaaatgactccggcaaataaagcaccacttgatcttttccaccaatcaactgcatcactctgtcaatttcagaaccaaatgccgcgccgtctgcaattacaagtatgcgttcatttttatgcatatttaaataatggaaaacatttgactttccattcattgtctcacatttcaattgctgttgcctacatacagaattaaaaaactgataaccggaattactgtcttccgttattacaacctctggtttgatatccttctctaaagtctgtgctccatatattctgtaaaactcatgataacacggttttaatgttccgtattttcctgaagtacgaattccatagatttcctccacgctatacggcaaagaaggcaaggattccctggaaacaatgacataataattatctgttttctgaatagtatctgcgaattctactgtcttgataaattcgtttccctcatcaataaatacaatactatcctgcattgctgataactgttctttccacagtgagccttcgagcacataacattttttgtcacacgtcagttccacaggggtcccggatggattgtttacgtattcccgaatcatatctaccaatgtggtttttccagttgcgctgtctccccggatgaccgtcagatttcttcgaatttcaaaatcatattttaagcgctttgttgatacaataattctatgttttcccttcattaaacaaattctcctgcaatcgacaccagttcttccattgaatggacaatctcacccgtattcaaaatacgaatgacaaaaggatcttttccaaaattcattaaatgccgcagattaattgtacggtcttcggattctgctatttttaataaccattttgcacaattatccccacaggttgatgcattaaaaattttatccttatcaaattttacaaggattaatgtctttactcccccggataaacctgtcggtggaatttttcccaaaacaggactgtcaattacgccactatccagcaccgttgattgatccacatcctgaatcatttcttttacaaacggatctataatccaactgtcctcataatcatacttaaaatacgctgccgtgttatacacagactcctgcatgtcgccgtaataaatattaagcatacatctacttccttttaaatttatacctttttctattttagcatatccttgttccatacactatcgctttttaccaaaaggacagcaaaaaaggcagcctgtgtttcattccggctgcctttttaaaacatattatttctggattggttttaatttatttagtaccatgccaagtgctgctacaatgattgcagccacaatcgcttcaatgactccgttaaagctgatgacaccaccgatgattccaagcacggctcctgcatcgacactcagggcttttgcatatgcatctttgtataacacaaaaattccgcccataaccagtatcgtattgaccattgcgcctgttacacccgcatagacaaatgcacagactgcgccggatttcagtaccgtatacacttccagtgctataaaaacgaaccatccaaccagtgcacttactgcatacaatgcaatatctgacaatggcttcttgtcaaacacatgaagcagaaacgcacgcgcaccaagaaacaggaacacaccgatcaggatattaaacacacttgcccagagaattttgtgccgggaagaaagtgctttctttactccgatatatacaaaatatggcaggattcctacaagaatacgcggtacaaaacagataaacgcactctttacgattccgctggtgcctaccatgctggccgccagcaccggggaaaatacaaatgccgaaagtgaggtcggcataaccgtattcttgataaagctggtcagaccaaagataaatcccaaaaatccgcccttcttcggtccacagaataacgatcctaaaatgacagggatgtggatgatggtcgcattgatcaccacaagcgggatgtagcccagcggtgtaaacgccataatgataatgattgctgcaaacagagcggtcagtaccagctccgcggtcttattgtttcgcattggttcctcctgttccagatgaaagcggatgttatgtcttccgtctctctcttttttcttttgcgaataaagtaaacattaactttatcagtttacaccttgctcctcttatggtcaagtcacatcacgccatcggtttttccaaaatctgaatcaccgtatttcctttcattttcaggaaaaacggcattcccggttttgcatccgtataagtttccatatatttttcaaaaatcattttatcttttgttactacacgaatatcggcatctgttcccccaaattctcttgtccaatccaaaaaggagtactccgtctgatctgtcaatgttacttcctctgttttttcatccttattgtatatataatatccgtcaggcatatcgtcatccgtgtgtttgtaacttgccagtcgatcactgtccccggaactgatatactccacgggatcgatgaccagtgtatttccattgatttcctttatataagcgcagagttctgttgtatcctccttcatactgtctgcagtttctgtctcctcagctttttctgtaattgtctgttttccacatcctccaagtcctgaaatgcacgcacacatcataagtaaaatccatctctttttcatcattttctctctcctttaccagatccagtgtttatatattttttcaatttcttctttttggattgtatctccagccagcacatatacgctgtttccatattccccatatgcccaaaatgtctcatccgtataccgatataaaaaaacagtcattccgtttattctgatttgttccacagaattataatttgtgtcaaaaatcattttctcatttgtcacaattgtttgctggaaaatcaaatgctttttgtcatttccatattccaaaacggatgtggtatccgtaattttttcttcgttcagccgatagttgtctggaatatactgcggttttaaaatagcatcggaaatcttctcttcgtccgattcataagagtaaatactgatgttaccatccagcaccatttttatcgtatgaaaaaaccgtacccggtaagcccccacactcatcgtgacggtgagtgctcccacaagcatcacaaccgctgctgccgcaattttctgtgtgattttcttcaactgtttttcggcatacatatacttttctttctgtatcagccgcttcatacgctttctgaatttatctgaaaaaacgtaatctttttgcgtgcacacttccagttgccgtaccattgctgcatcaacgatcggcattttttcataaagccattcgtccgttactttcattcggtatctcccttcttgattttttccagttctttttcaattagccgttttcctctggcaatccgctgccgtatcgtcccctcccgaagtccgcatattctggcaatctcccggttttccagatgtgcggaatattttaacagaaatatatctctgtattttggtggaagattttttaaaatatctaacactccatgttcttcctccggtgccatataagtaagctgcccggtttcttctggaagttcatccatatagatttccctgctttgtaaccggtttcttctgcggtaaagatcaatggctgcatgttttgtaatcgtaatcagataacgtttcgtggcagtctcctccggctgtccgacgttttccatatgttttgccacccgtacaaatgcttcctgcacggcatcttctgccaactggtaatcatgcagaatatccgccgccactttcaacatcagataacgatagttttcgtacaggatcacaaattttcgtttttcttcgggtgtgtccaccatcatcagtaaaatcacgcgcgttcctcacttttgttttgtctctgctaactataacgaacctgtcggttccattgttacatattttcagacaaaaataaaagacatccggattccttccatttgtccattgaaaaagtatcgctgtagcgatatcctcgattttaccgccaatacccgcgatctagacattgatgtcgtaaaatttgcgcgtgtcttaggctgtaaaacagaagactcgttacaaatatagtaaaaaccgccgcggaaatccgcggcggtctcttttcacacttatataaaatgaaattatttgcacatctcagcctttaaaacaactcatgcatcaatcaaataaagaatattctttttctgcccccacatttgatactacacataacaatgccccataatttggagtaacatttttgttaatggcaagaaaacacgtttcgccttcacctatataatacacatcgcttacgctgtaatattctgcggtctccacccccatcggttctgttttcggattccagctttcttttttatctaattgattcttttgttgttttgttttcaaatcatactgcaactgtttttcattatcacttagctggatataccgtccatccttcgatacatgaataaatgttgcatcatctccctgtaatcccttaaaatgatttttttcaaaatcaacataatccgtcaggtctgaagaggaaagatcataaacatacacccccatattgtcataaacaactaattgtccctttccgacataaccaattttaggcattgtatcatcaaaatttaaagttgatttgtaacttgccagccttgcaagttctttcgaatcaacattattcaaaccaatttttttataaagaaaacttccaaacaatactactaataacaatccactggcaacaactatatatattgttttttggcagctatattctttcccaatatttttaatccgcatcttcaatgtactcctttcgcaaataaaaggtcgcatagctgatacatattttaatctacctttatcacataaccgaagtaatgttctggcataaaattttctttcctccattgatgtattttgtaatgtctgttcatcacaggccatttctatatctttatttactccaaaataaattaaccaacataagggattataccaatttaaagcaagagctatataatacaacatcatcaatagataatctttgcgttttatatgggtcttttcatgctgtaacactatctgccgttgctctggactcaaatcaaatggcaaaaatatttttggtttaactaagccgataacacaagccatgctttctttccactcatagatttcatcctgtgaagatatcttctttgcattctttgttcttctacaaacagcaatcctctgtataatataatatacagcaaaaaccaaaagacctatataccacaatatcataagaatatttatattcttcttttttcccatgtatggtttcgatgtattttcgtcttttggaaatatttgcaaagaattatcacttttcatttcctgtgcagaaagattttcattcttttcaacaaatgtttccgaatacaaaatgccatattccgtatatatagataccggaaacaataaacgtatcaaaagtatcacccacaacattatttttatgtgattagactgttttctcaataaaaatcttataaacaaaaatagtataataactattattgttccactcaaagaaccactataaaatttaaaaaaatcattcatgtagttcctccttatattcgtctattactttctccaattcttgaatatcttctcttgtcagatttctttctttaataaacgaaaggacaaattgcggtaatgaatttgaaaaatattcctttataacttcttttctctgaccattttcataatctgctcttgattttaatacagtaataactgcctctgaattacaaaccatttttttatcaactaattttttcaaattagtataggttgttgactttttccaattaaaccgctctaaacattctttaacaagtttatttgaaggaatttgacccttctcccaaattacttccatcaattttaattctgcttttgtcaaataagttttcatttctatcaccgtatttattactttacctatttatttttggtctaaactacttagactacttttagtctaagtcatttaaacctgtttgtcaagtatttcctcacacaaaaaaaccgccgcggaaatccgcggcggtttcttttcacatctttatgtaagatgaaattatttattcttcatttcagcctttaaagcttctgtcaaagctggaacgatcttgttcagatctccaacgataccgtaatcagctacggagaagattggagcatcctcatccttgttgattgcgatgatcaggtcagactcttccataccagctacgtgctggattgctccggaaataccgattgcaaagtagatctgtggacgaaccgtcttacctgtctgtcctacctgataatcctgtgctaaccagccgttttctacagcggcacgggaacagcttaccattccgccaaatacatcagcgagatcctgcagcatcttgaagttctctttgcttccaactccacgaccaccggatacaagaacctttgcatccatgatgttctctacatttccaactgccttaacaacgttaagaatctcaacgtaacggttgttcttctcaagtgtaggattgaactcaattacttctgccttgcgtccagcctcttttggaagcttctgcataacaccaggacgaacggtagccatctgaggacggttgtccgggcaggcgatggttgcgattgtgtttccaccgaatgcaggacgggtcatcagtaactggttgtgcttctgctcgtcttccttaccaggaactgcgttgattgggaaatcaccgatctcaagctttgtacagtcagcggtaagtccagttgcaactcttgcagatacggtaggaccaaggtcacgaccgattgctgttgcaccaactaacataatctctggcttgtactcattgatgactgctgcaagagcctgtgcatatggctctgtacggtatgtctcaagctcagggttgtccactacgataaccttgtctgcgccatactcgcctaactcatctgttaagccctttacgtttgatccaagaaggactgctgttacgtctgttcctaaatcttttgcaagctcctttgcctttccgattaactcaaaagcgatagagctaagttcattgtctacctgctgtgcgtagataaatacgcccttatattcttctaaacccatgttattcaccacttttctctataatcttagataatatgtttctctttgaattttccgattaagtatgcaacggactctgcaggatccagatttactttctctcctgcacccttcggtaccttatcagatgccttagcgatctttgttggagatcctttcagaccaaggttagaatcatctacatcctttaagtctgctctgccccatacggtaacttctttgtcacatgcatcgaaaattccacccggagtcatatatcttggctcgtttaactcagaaagagcagtgatcaggcaaggcattttagccttaacttcatgatatctgtcctcatactgacgcttaacgattacggaatctccctcaaccttgatatcctcagcataagagattaccggaagtccaagatgctcagcgatctgtggtcctacctgtgcggtatcaccatcgatagcctgacgtcctgtgataatcagatcataatctaagttacgaagtgcaccggcgattgttgtggaagtagcccatgtatcagctccacctaatactctgtcggtaacaagaatagcatcgtcagctcccatagccatagcctcacgaagaacagcatctgcctttggaagtcccatggtaagaacagtaacctttgcaccgttctgatccttaattctaagtgctgcctcaagaccagctttgtcatctgggttcatgatagcaagcattgcagctctatcgagtgttccgtctgcgttgaactttacgccgccctttgtatccggaacctgtttaatacatactacgatattcatgtattatttatctccttttcttcaatctttgtgatacaactgtacgattatcttaataatgacccagaaataaccatacgctgaacttcggaagttccttcgtagatctctgtgatcttggcatcgcgcatcatacgctctacgtcgtactcacggatatatccgtatccaccgaataactggacaacttctgttgtaacagccatagcggtctctgctgcgaataatttagccttggcagcttctacagaataaaccttctgtgtagccttagccatggcagccttgtaaacaagaagctgagcagcttcgattcttgcagccatatcagcaagcttgaactgtgtattctgctgctgtgcgatagaacggccaaactgctttctttcctttgtatactcgatacaacgatccaaagcaccttctgcaataccaagtgcctgggcagcgataccgatacgtccaccatcgagtgtgtgcattgcgattgggaaacctcttccttcctgaccgagtaatgcatcctttggaattctgcagtcctcgaagatcagctcgtatgtagaagatccacggatacccatcttcttttcctttgtaccgaaggagaatccaggagcacccttctctacgataaatgcggagaagtttttcttctttcttcctctcttgtcctcggtaatgcttgtgattgcgattacgatgtaaacatctgcaaccttaccgtttgtgatgaaacacttagatccgtttaaaacccactcatcaccatctaatacagcctttgtctggcagccctgtgcgtctgtaccagcgcctggctcagtaagaccaaaagcaccgagcttctcgccctttgcaagcggtactacatatttcttcttctgctcttcggtaccgaatgtcatgattggatcgatacaaagggaagtatgtgcagatacgataacaccggtagttgcacaaactttggataactcctcaacacatgtaacgtatgtcagaggatcacatccctgtccgccgtactcctttggaaccggaattcccatgaatccgtattttgccatctttgcaacagtctcagccgggaactgttctgtctcatctgtctcctgtgcaagaggttttacttctgtctcagcgaagtctctgaaaagaccgcgagccatctcatgtttcttgtctaaagtaaaatccatgattttaacactccttaattatgatttatttttatttatacttttctactgtgcgtctacaggtgtctttgtgcggtctgcattgtagatgtagaatcccttaccagacttagcaccaaggttaccaccacgaaccatcttacggatgagtgggcatgcacggtacttgctgtcacctgtctcattgtaaagtacatccatgattgcaaggcagatatcaagaccaatgaaatcacctaactctaaaggtcccattggatggttagcgccaagcttcatagctgcgtcgataccagcgatatcggaaacaccttccatcttgatgaaagcagcttcgttgatcattgggattaagatacggtttactacgaaaccagcagcctcatttacctgtaccggagtctttccgatctctacagcgatcttcttgattgcttcaacagtctcagcaggagtatttacaccagcgataacttctactaacttcatacggtcagcaggattgaagaaatgcataccgatcattggacgggtaagtccgtttccgatctctgtgatagaaagggaagaagtattggaagcgaagatacactctggcttggcaatcttgtctaactcagcaaatgtagtcttctttacattcatatcctcgaaagcagcctcaacgatcaggtcgcagtccttgcagaggtcttcttttaaacctggagtgatcttggcaagaatgccgtcaaccttctcctgtgtcattttctcttttgcaacaagtcttgcatatccttttgcaatcttgtcttttccgccttcagcccactcctgcttgatatcgcagagtgctacttcatatccgtcaacctgtgcgaatgctttagcgattccctggcccattgtaccagcaccgataactccaaccttcattttagttcctcctaaatattaaatatattcacatttcaaggggatgcagcgcaccccctctatgtatcttatctggcaaaaaaattagtatttctcaacgattgtagaacatcccattccaccaccgatgcaaagtgtagcaagacctctgttagatccacgcttctgcatctcatgaagcagtgtaacaaggatacggcatccagaagctcctaccggatgtccaagtgcaattgcaccaccgtttacgtttaccttgctcatatcgaactttaagtctcttgcaactgcgatagactgggcagcgaatgcctcgttagcctcgatcagatcgaaatcatcgatagaaagaccggtctttgcaagaactttctttgtagaagcaacaggaccaacacccatgatctccggctcaactccgccaagagctccagctacccatgtagccattggtgtaacaccaagctccttagccttctcttcgctcataacaacgattgctgcagcaccatcgttgattccggaagcgttaccagctgtaaccagtccgccttccttaccagagcagcaacgtaacttggaaagagactcagcagttgttcctgcacgaggtccttcgtctttcttgaagtcaaccatttccttcttaacctttacaggtaccggaacgatctcgtcatcaaacttgccggctgcgatagctgcctcgcacttctgctggctgtttgcagagaactcatcaagttcttctcttgtaataccatacttgtcacatacgttctcagcagtgatcatcatgtggtagtggttgaatgcatctgttaatgcatcgttaaccattgtatcgataattgttgcattgttcattctgtatccgaaacgagcctttgtcatagcgtaaggagccatagacatgttctccataccaccggctacaacgatatcagcctcaccagccatgatcattgttgcagcatcgtttacacatttaagaccggatccacaaacaacgttgattgtgattgccggaacttcgatcggtaaaccagccttgatggaagcctgacgagctacgttctgtccctgagctgcctggattacacaacccatcttaacttcgtcaaccatctccggcttaacacctgctctgtttaaagcttctttaattacaattgcacctaaatctgctgctggagtattgcttaatgctccacccatcttgccgattgctgtacggcaagcacctgctaatacaactttctttgccattcttcgttctcctttaaatcaaactcgcacccaatgatgctgttaattttttaacaatgtctataataccacattttccgcacaaaatcaatgaaaacctacgttgttcataaaaaattcttcatttattgcaaccggctctgtttcatggtatatttatggtatatttcaagcaatactgaggggaatccaaacgggagatcatgtgatatgaaatttgtaagaacagaagacttaaaggcaggcatgcgtcttgccaaaccaatttacaataaaaaaggtgtgctgctttatgagcgcaactccgcactcaccgcgccgggaattgccagtgccaaaaatttcggtctgatcggtgtctatattcttgaaccggccgaaccgcttcctccgctttcccgtgaagatctggaatttgagaagttacagacggtatacattttccgactccgggaagtgttagactgcattaccgagcgcagaaaactcgaaaaatacccggtatttctggaagatatcctttcccactacgggtctttaaaacaccgtgtgaattttaaccagaatctgcgtagcagtgatgatttcatgtacaagcatgcgatcagcaccgcaatactcgtaaccatgatgggcgcccatctgagactaccgaaggaaaaactccgtatactgaccacggctgcccttctttatgacaatggataccggaatgttccgcggaatattctggaaaaaggaatgaacgacctgtcctcatccgatcaggatgtcatccagctttctctggaaaaaggactcgttccgctttccatgtaccggaatgattttgacttttttccacgcgcactggctctgatgcagacctatgtatatgaagaccacctggaaaaactcgcaaccgctccggatcaggaattacaggaaatggcatccattctgcgcatcgccgactggtttgaccagatgactgcgatgaacagcggccatgaaccgatgtcagaaattgccgccatgcagtatttcaaaaaatacccaaagaagtttcttccggtgcttgtcacagcacttgcagagtgtattcatattgttccaaaggccgccagtgttgatctttccacaggtgataaaggcattgttcttatagaaaacacccgtgattttatgcgtccggttgtcctgcgcctttctgacaatcagatctacgacctgagcgacaaaaacgtttatcaggaaatgcaggtgaccgacatcatgaaaaccatggataaccgtgttgccatggatgaagaaaccctaaagcaatttgtaccggatgaaaagctccgacaattaacgcaggaattccgtagaaaacttgctgccgggaaaaaatagcataaccgtaatcaccttccccatgatttattcatggggattttttattttccacttgacgtgtttcctctattctgttatatttacttcatcagacgtagtacatctatcatagcaacgacagacgaaatacgacagatacagtaaggaggtatgcatatggcaatcagcagtgatgttatccgtggttacaatgacaccatgattctttatcttctgctggatcagccatcctatggttatgaaatctccagacagatcaaaacgctctcccatgaaaaatatattatcaaggagaccacgctctattctgcgtttacacgtatggagaaaaatggctatatcacatcttttcaggatcagaacactgcaaccggcaaacgccgtacctactaccggatcaccggcaaagggcgtgcttactatcaggaaaaatgtgaggaatggctgcttacgcaggaagttgtagaacagtttatcaggaaaggggaaacggaaaatggaagctattagaaattatctggaaactatgtttttaaatcttccaaacacgccagaagtatacaaagccaaaaacgagctctggcagatgatggaagacaaatacaccgagttaaaaaatgagggaaaatcggaaaatgaagcggttggcaccgtcatcgcggaatttggaaatctcgacgaacttgcagaagatcttgggatcaaacagtttgttcaccagccgcggcaggagcagactcccaatgctgtatcgctctctatggaagatgtcagacagtttctgcgggaacattctcgtcattcctactttgtggcactaagcgtatttttgtttatcctttctgcctgctgcccgatctttttcggggctgctgcagatacttcgctgcgcagcagtgatgtacttgatgcatccggtgttattctgatgtttgttttcatagccatcggtgtgggcatgcttgtctattcgaatgtatgcatggggcactggaaacacttagaggaaggaaattttgttactgattttgccaccacagactacatccatcacgaaatggaacattataaaagcacacatgcgctcctgctgaccataggtatcatgctgtgcatcttaagtgttgtcccaccgatccttttagatgcggcatccagttttgcggcagatacacttgaggactgttccgccgggtttgtattaatctttgttgccatcggcgttttcctaattgtaatcagttccatgcgcatgggcggatatcgcacactgctgcatctgaacaaccagaacaccattggcggaaactacgttccggagcagcaggatcgccagcagtaccataattccacactggctgcaatcatgtccgtctactggccaaccatcacctgcctttacctgatctggagttttctttcgttcgactggtggattacctggattgtctggccgattgctgcgattgtagaatccctgatcaaaaatatcagcaaaaactaatgggaggagaactgtcatgaaacgaaatgtttatttaatccttattaccgtcattacaattctctgtatcattgcaggaaccggctaccatctggtgcgttttggcctctccgtggcagagggactgccgtccttcagtgaatttatagaggccatctctgactgggatgatgatggtgatgacaatgatgatagcgatgacaatgatgatagcgataatggtatatccacatccgtagatgccagccaaaaaaatctggatgccttctcatccatcaatgctgacttaaatgttgtcgatttaaccatccagcgggggaacactttttccatcacctgcaaagccagcaaaaagcttaccccggaatataaagtagaaaacaactgtctgacaatcacacagtatgccaaagcccacaatgctctcggcagaaacaaaaaatgctccgtaaccatcacggtcgccgatactttaaccgatttaaaactccatacaaacgtgggcgatgttgacctgtccggtctgaacgttctggcacttgacctgcgtgccgatgtcggagatattgatctggagaactgcactctggagacttccacactggatgcaaatgtgggcgatattgatctggaagattgtacctttacttccatggaaattaccagtaatgtgggagatgtcgatctcgattgcaaggaagacctgtctgattaccatatagaattaggaaccggtgtcggagatgtaaatgttaatgatacctactgtcaccgcagttactccaaccaaggagattcctcacactcgctgaccatttccaacgataccggggatatcagcttaacctactgattccaaaaaagagcggaacacctgacggtgcccgctctttctttttcattatcttttattttaatgtaagaaacagatttgctttcttgagtgccggacgaagtgccatgtagataattactgcaacaacggcagaaatgatggcattgacagaagtcgttgtgatattccataccagtgccacttctgcagccggttttcccatcagcacacgtttgtaaaaatatccgaacagtggatcaaataccacattaaatccaagtccgcagaccgtggcaataattgtccactttaatacatgcttattgtcatttgatgtagagatatgacccatcttgtgtgcaatcagtcctgtgatcagaccgatacaaaatttcaaaataaatgtctttggcgcatacacaatataaaccggatccagcagatctccaatcgtcataccaattgctccgccgattccgccatacacaccgccgagaagcagtgcaccaagtacacataccgcattacccagatggaaggatgttgcatctccccccggaagtgttaccttgatctgtaaaaatgtaaataccacataagataatgctgccataagcgcagtcaatgtcaatttgtaaatattttcgtgtttcataaccaattcctcttttctgtaaaatctaacgatattttacagcagaatggttatatgtaaatatccagttttatatatttttatagggtcaggcaatcctgtctgaccccatcgctcttaatttccacactcaatggaaatttcattaaaggttccaagaatatcatcgacttccattgcctgtttttccgctccggatttatcaatgattgcatgcccctgatgcatcatgagaagacgatcaccgtattccacagcgtagcggaggttgtgagtaaccataatcgtggtaaccttcttctcttttacaatttttcctgtaagctgcataacgatctctgccgtcttcggatcaagagcagccgtatgttcgtccagaatcaaaaattcgatcggcttcatggtcgccataagaagtgccagtgtctgccgctgtccaccggaaagtgccccgacctttgtatgcatcttgtcttccagtcccaacccaacacttgcaagaagttcacgatacgcatccattctcgcatggttggttcctcttccgagaccataagcctttcccttgttgtccgcaattgcaagattctccagaattgtcatggacggacaggttcccttggacgggtcctgaaatacacgaccgattctgcggtgacggatataatctttctgacgggaaatatccactccattcaccaggatctttccggcatccaccggtatgctgccgcaaatgatgttcagcatggatgtctttccggaaccattgcttccgacaacggaaacaaactggccatcctcaattttcaggttaaaatcttcaaacaggcagatctcgttgatcgtacccggattatacattttgtgaatatgctgtaattccaacatctatgccaccttctttctctttttgcgatccatgccgagaactaaaatcacaagaaacagtaccgctgtaatcatcttcaaatcggaggatggcattcccagtttgatggcaattgccacacatgctttataaatgatcgaaccaataattacgcttgttgtcacacgaatgaaagaaacttttttcaacaggctgataccgatgatcacgcttgccagaccgatgaccatcgttccggttcccatagagatgtcaaaatatctctgctgctgtgcaaaaatacatccgctcaatgttaccagtccgttggcaatcgcaaggccgatgattttaataatgcctttgtccacacccatcgaagtgacgatggtctcattatctccgactgcccgcagcagatatccggatttggtgctcatataccagtccagtaaaaacttcataatcagcgtaatcaccagaatgataatcgtatttgcaaatggtgcaagcgatcccgtaaagatcttttttaccagcgcattgtcaaacagtgttgtcatgttataaatcggcacattggccctgcccgcaatacggagatttaccgtataaagagctgtcatcataataattccggacaacagatcccgtacctttaattttacatgaatcagtccggtcagtgttcctgctgccacgcctgccagaaatgaaatcagaagcgtcagtatcggatttactcccttcgtgatcagtaccgcggagattgcagctccaagcggaaaacttccgtcaaccgtcagatccggaaaatccagaatcgtatacgtaatataaatgccgagtgccatgatcgcatagatcataccctgttccagtacgcttaataccaatgtcatgtgataccccttatctttcccaaatatgattattttacggtaatctcatcaaaagtctgagccgcatccttgacataagatgcatccagcttcattccgatcttatcggctgctgctgtgtttacatataattctgctttggaagctgtaatatacggagtctccgaagctttctcctcaccctttaaaatctttgctgccatctttccggtctcgattccaagctgatagtaatcaattcccatggaagcaacacatccggattttacctgctcaatctcacttccgaataccggaatctttgcattatttgccttgtcaagaacggtctgcagagcatttaccacggtgttatctgtcaggttgcacaggcagtctactttgcttaccagatctgttgccgccatgtctatatctgcagaagtgttgattccggtatccacgatctcgaaatcatattttccggcaagttcctggtattcttttacggtactgcaggaatttgtctcgctcgttgtataaagaatacctatctttttggcatccggcagcatggcacggatcatttttaactgttcttccaccggaagcacatcggaagaaccggtaacatttcccacgcaggaaccgtcttcattggcaagttttgcagcaaccggatccgatacggctgtgtaaactaccggaatatctgcattcatggcagagttgtaagcactctgtgcacacggtgttgcaattgcacagatcaaatcctcttttgcggatacgaaactgtctgcgatcgtgcttgctgtaccggtatcggtctgcgcgttctgataatcaaccgtcagatttttcccttcctcaatcccttcttcttttaaaccctctaaaaagccttccctgcagttgtccaatgatccatgttctgcgaactgggaaattccaatcttataaccgtcctctgctgaggacgcatttttctgggtgtttgtatttcccacattactgtttccacatcctgccataagtcccatggtgcatactgctgtcaaaatcactgctaatactttctttttcataataatctctccttttcctttttcccgatgaataaaaaaaccgtctcaggataaaatcctgagacggtaataaagcctttgctctcttatcgcggtaccactcaaattgacaatgaattgtccactctgtcacatacatccatatgtgccgaattgataacgggttcggttcccggcgacacctactaaatgcaatctgcttctttttcaggccgccctcaaaagtccattcagcaaatcctttcatgctgcatcacaccacctgcagctctctgtgatgtccagataagcttacttctctttctcatcggttttctcttattgttatactttaatcctttttgctcggtttgtcaagttctacctccaaattccccggcgttttcgaatcgtatcatacatatcgtgttccattgccattactttttccacaggaacacttttaaaaaccggcatcttcattttaaaccgtatccagaagaaagaatacacacccaatgcaagaaatacggctccggacaaaagcagaatcgcattgcgttctgtcggatctgtcgaaatattacagatcataaacaccgtacctgcaattccgacaagcggcagcaccggtccaaacggaactttgaaacttcttggtgctttcggaagacggtgccgcagtaccagcacatcaatatgtgcaaaaatataagacaccatccagaataccgatccaaccagaataaaaaaggaaattgcatccgatgaatcactgctgataaatgcaaatacaagaatcagaatactgatgaaccacacaccgacaaacggcacattgtttttgttcagttttttaaagcagcgcggcatcatattcatttttgccattccctgacagatacttgccagcccgttgatcgcagagttctgggaactgatcagtgccagtgccgccacaaaagccatccatatttttccgacatttcccagaagattctccccgtacagcagatgcggggctgcagaatctgccagcttgtcccatggggtataattgtgaaatccgaacaccagaaccgactgcacaacacagatcagtcccagcccgagaaacataccaagcggtacattacgcctggcatttttgacatccttcgaaatcggaatcacatattctgcaccaataaacagccagaatgcaactgcggtcatggaaacaatcgttttccagtctgcggaaagaaccatcggctgactcaccttttttcctgtgccaagtcccagcatgccgatgacacccataatcaccatcgatccgaccatcagatatgccactgcatcctgaatctttgcaaacatatccacaccctttaaattggcaatcagaagaatgaccgtcaccagaacggtataggaaaagtttggaatcggcagatgaaaaatttctcccatggcatatgcgaaaattgaggcttccacaccggaagacaatacattgcagaacagataccctcccaccatggaaatcatcgtcggaaacggtcccaggcaggcaagcgtatactgtgccagtcccccggtcgtattcggcatcagggcattgagttccgacagggatgcaatggttgtcatgttaaacagacaggcaattaccatggcaaaaataaaggtcacgccaatcgtccctgcgccctgtccgagtgaaaccagacaactcgttgcaatgacaagtcctacagaaacagaaataacacttttgagtcctaacttcttttcttccataaacagacccccatcccctacaacgctttttcgccctcatcaccggtgcggacgcggatgacattatccagtttatagataaagatctttccatctccgatgtgaccggtatacagctgttccttgatgatctctacgatggaattcacacgctccgtttccacaacaatattgatctgctgttttggaagcagttccatctcttcaagctcatccacttcatactctctggttcctttttccacaccgcatccaagtacctgcatcacggtcattccccgcacaccggctttgctgagtgctgcttttaagctggaaaattttgacatgcctgtaattacttcaattcttgacaaactcatggtctttcctccttggtataatgctctttacaattccagttccggaatctttgttcctgtaatgagccgctcataaccctgtggggtaatcccggcatactgtttaaaatctttgatcatatgtgcttcgtcataatagccgcactgctgcgccagtgcatctagccggatcctctccggcattttatttatgacatgcagcagcttctgaaaccggacaaaccgttcaaaattctttggcgaaattccatgcacctgctgaaaaacacgccggatataacattccgaatatccggtttcctctgccagctgccggatacaaatgcatccatcggtatcataaattctctccctgagataattttccagcttttgtatgccatccgccagttcttttccacgcagttttgcatattccgtcgtaaatacattgacacgctccgaaatatttttactcccggcaagtttttcggtcaggtgatctccaaacagattgccatcaatctcgagatctttgttaaccagatcccggatggaaagttcttccggcagaatacagcttcccggctgaaaacggaccccaaaatatgaacgtccgtcctcaaactcccagccttttgcggcaagaaccgttccgccaatatacgtcttaacatcctgctctccgattccaaacaacaggtccacactgccatccggcaccgctttcatctctacctttgaatttttctttttggaaaattcataaaagtgggagattccggatttcatttctttttttacctcataatcatctgtatccagcaccagatacggctgcattggcatgacgtttttcattttctttcgccccttgtacttaaacctctgccaggaccgcccggcgaaaagtacttaaaaaggcgtaccttttatgccatatccggctgatcccataaaggcagttccacgccgataccttcttttaatgcattgcggtatacggtaccgccccaggcaatgtcctcaacaggcataccgcctaccgagtatacaatgatctcatcatcgctttcccgtcccggatgctttttattaatgatatcggcaatatctacaatatcttcccgctgaatccgtccttcgtgcagataatccgtaaacttggaacctatgatctgtaccatctcataactcggatacggaaattcctctgcccaggcttcatacagtttatagttatccaccactttcttgcagcggttgatcagaaaatcatcatcaaaccgtgcagccgatggcagacagatgagtgcaccttttttgacccagtcttctgcgatatatgggaaatcgatttcttttaccggtgcggtggaagtcacacagatgatgtcactgtcttttacggcctcttccatcgaatcacatacgatgacctgctgaatctgcggacattccttctttacgaactcttcaaatgcatgcagggaacgcagtcctcttcctttcacttttaccgtagtaatcttcgggcagacacttaaaaaagccagcagacaggttcttcccataacacccggtccgataatagtaaccgtttcggaatcttttcctgccagatattttgccccgactcctggaattgctccggtacggtaacagctgacaagatttgcagacatcagtgccagtggcgccccggtatctttatcgttcaacatcatcatcagaatggaacgcggcagaccggaagctttattctcacagttacttccataccacttcattccggccatctggtattttcctccaagatatgccggcatcgccataaaccggcggtcgtctgcatttttcggcattccctcaaactgcggatcatctggaaaaatgacctgtgcaccgtgggaattatggttgactccggccatcacataatcgcctttgttcaatgtaaccagcagatcttccattgcctccacacactgatccatgttctttactccggccttgatcatatccggttcactcaaatataaaaatttaatcctggtatccatatgcatttcctccttatgttttcagaggtatggaatatcaaagcaaataaacaaaaaagacgccatagtatcacctactatagcgcctttgctacttattcgtgcttataatataccatactatctttttgattgctactcctgtattcttttttatacaacaatcctgctatcttaaatcactgcctgaaaccggtcataccgcagttcatgcagatccagtgtggtttcttttcccatggccagttcggataacagttttccgacaatcggtgaaattccaaatccgtgtccggtaaaagcacaggctaacagcagtcccggcacttctttaaccggtccgagtaccggtactccgtccgcacacagatcttcatatccggcccaggtacggacgatctttgcatcggcaagttttggaatgtatttcataattccccggcagatgcacggagcagtgatacttgaagtaatcatatgcccattgtcacggttttctgcctcaaatccggaagcacctccgaatacaaaagatccatgattcgtctgatggccgtagaaatccgcatctgcggtaccaagcatctgtggaaacatctttggctcagcctccgtaaccagtgcctcgatcagctctttgcgcatcgggatgtcaatgccgacactcgctgcaatcgaacggctttcgtatccggatgccagtacaatggtttctccttcatacacattttctgcggttaccacacgtctggcttttcctttgatcttctggatctcgagcacatcctcacctgtgataaactctgcgccaagctctctggctctcttgtaaaaaccgagggttgcaacgagcggattggcatgtccgtcggtcggacaccagctggcaaccgtaatctcatcgcttaagtatgggttgatctcacgcacttcttttccatcgatcatccgcacatccagtcccagtgcaacggcacggtccgtcagtccctgtaagatttctttgtgctttgctgtctttccgagacgaaggtttccttctttatggtattccacacccacaccgagttcttcggacagtgtcggccacatgtgttccacggcatacatggcaagcggaagttctctcggatcacgtccagactgtcttacaccgcctccgtttcttgaggaaccgccgtttccgatatgatcgcttttttcgagtacgatcacggaaaccccttcttttgccagataataagctgttgcgcatccgatgattccaccaccgataattactacttccgcattattcttcatcttcctcgccctcctttgcctctgccgcaaacacgcgcatctcgatcggacgcatcggtgcccgggatgttgccggttccagttctgccggggatacgttcagttctcttgccacgattcctttgaccagctttgcacaggtctgtccctgacagagtcccatgccggttcttaaataccggcggatctccgtcagtgtgaacattccatcgtgcaccgctttgcgaatttcccctttggttacttcctcgcaccggcagatgatcatatcgtcatccggtcccggtacgaaaggtccgatatctcttgatctatcattaatctcatgcataattttttcctcctctgtgaatcaggcttctgccttacgataaaatctggccttcattgccatatctgccggcaccttaatcgtcagcagattcgtatggtcaaatgccttcgatgtcctgacggataccacttccgcctcacagattttttcaccgctccggctcattccgtatcccttttctcccttttccggaagtggaaggaattcatatggaagcgtcacggttgcaaatcccggctcatacgtttcatcgactaagaagattgcctgtccggagcaggatgccacgcacataccgcatccgatgcaatccacatccggatctaccaccggaagggaggtaatattttctccaatcctgatgcaatgcttcgggcatgcatcctgacatgggttacacggaatgttctgtgtacattccatcaccggatgaacaccgactttgtgtgtcacgcccgggaagcgttcgatttcatcatctgcaacatatccttttttcagaagattcatggaaatatcgattccttcttctgtcttctcgataaattttccacgattctttggagcaaacatgccctggcgcagtccgtcaagtgcatcctcctgctctttggcttttgtctttaattcttcctcatccatatatcccaggtaatgggcagctgcgattcctgcgatacgtccctcgatcatggcagagctggcttcctcgatccccgatacatcgcctgcgacgaaaatgcccttaattgaggtttcgccatattcatcacagatcggaacctgcccgccacgctttggattgtcttccatctcgcaacccgccatcttcaacagctgcgacataggagaaagtccgactgccaggcagatcgtatccacatcgaaatgcttttcggttcccggaatgaactggaagtggtcatccacttctgcaatcgtaacaccggtcacatactcctcgccctctgcttttacgatggtatgggaaagataaaacggaacaccggttcgtgcaacctttgctgcatgaactccgtacccaccgacacggggtgctgcatcaaccagtgcaaccacatcacagccgcactgcatcagctggaaggatacgaccagaccgacatttccggaaccaagcatcagtattttgtttcccggttttaccccgtgcagattcatcatcgtctgtgcggctcctgcgccgatgactcccgggagattccagccctcaaaggtaaccatattttctgcggctcctgtagcaatgattatggaatctcctttgtagtgatgaacctcatctttgatccttaccacaatttctttatccagatacatgccgataacggttgcattcagcacaactttcacaccggcatccgctgcttcctgcaacagctgctgcccgatcacaaaacctctgacttttgccttatgttcctttgatccaaagaatttatggatctgcttaaacagctgtccacccggcttttcattttcatcaaatactacaactttcagtccccgctttgctgcctcaactgctgcagacaatccggatggaccggctcctacgataatcagatcataacgcttcatattgttcactcccctctactgttcttcaaacggtttatccgatacgccgtactgtgtctggactttcatgccctctgcaagcggtgtcatgcaggtgcggacatttggttttccatccacaaccatcacgcagtcggtgcatcttccgatcgcacagaagattcctctcggtttgtgttcctttttggtataacggtgaaccatcacgcctgcggcttttaatgctgcggcaattggctctccctcgtatccctgtaattctttaccgtcataggtgaatgtaaccagtttccctttctgctgttctccaaggattggatgttctgaaattctgctgctcatataactccttcctttctatgtgtaatcatgtatggtttccgtgaaaatcaaaaagacacctatgattctcatagacgcctttgtctaatgcggtgccccgtaaggggtatcgccttcgtacatcgcttccgcgtgagcggaactctcatgcgatgtgctccttattgcggtgccccgtaaggggtatcgcctgcggtacatctccgatgtatcgccctccattatgttttttccaagaaccaattacttttcttaacttgtccttatcataccctctctcccaacacatgtattgtaaaaaacgatacaacaaaaaagaagctgtgcattcatgcaacagcttccttctttgttttcatctccgacaaattatccttcaatcacttttttgattgctgcaaacagctcatcgtacgtctcatatgcaggaatatccggatactcagccttgatcgcatcggtactcttaaataagaaaccagccttgctggcctggatcatgccaagatcattgtggctgtctccgctagcgatggtatcataaccgatggactgcagtgccttgacggttgtgtacttggacttctcacagcgcatcttaaagcctgtgatttctccgttatcggcaacttcaagcgagttgcagaaaattgtcgggtatccgagttttttcataagcggacctgcaaactgggaaaacgtatcactgatgataatcacctgtgtcatggcacgcagtttatccaaaaattcctttgcgcccggaatcggatcgatctttgcgatggtctcctgaatctctttgagtccaagaccgtgctcctttaaaattccgatacggtatttcataagcttatcataatccggctcatctctggttgttctctttaattccggaattccggtctcttctgcaaatgcgatccagatttctggtaccagtacgccttctaagtccaagcaaacaatttccattttttcttcctccatgtttaaaataaatatactactattccgatttagttccattgtaatgaattcggcagtccctgtctagtaccaaaaggagattcctattgatcctattgattgataaaaacaagagaccacaaattatttctgtgatcccttgtctgtctatctttccaactgctcataccagtcttgtggaaaccctatatgttttaacgatatgtcatcctcatattcttctattacagcccttaattctgtcataaccttgctattccattctttcttatcgggatacaatcgtttaagaactaatatctgggaaaataattttctattttgtggtgctacagattcctttggcattttaggtaatgccgtaaatgaccaataatataaccttgaataatgggcacatcgatttcttaagtcagtaatacaacgtaaccagctttttaaacacgctactgatgtatcatatatctcttttgctatatatttctggtcgcccgattgtaaatccgcataaaaataagacagcatccccatcgaaaagaattcgataattacccatatcggaaattttccatcatatttttccttatgatgtttaacaactaaactgtttttattttcctctatgcaaacattcagtagttttctaaatttatcatgattgtgttttttattataaatactcttatccatgtaccccaaagatccatagacatgtccacagtaataagcaagttgtgttcttaaatgtaattcaattctctctatacaattaaacagtactcctcgtaatttactatcaaacttataaattcgttgaattctattaaaacttatatctgcaaaatatgttccattcttttttctaaacggaagaaaataagcagataaacgataatagtttgcctgctttaaaaaactgatacattccgtatcattattcactataaagcctttttctttgataagttccacttgctgttcataggttttcggctgttttataatttgataatcatgccctgctttactatgattttcccgtacaccatcgcttatatccactattatttctcccaaaataaaaatgtctccccatgggacacatcacttacgtgagaggtgtggggagtcctgttgatattataatatgctatttctataaaaatcacaaccattttttaatttattttttctgtctaaatacaatcgttactcttcacttctgttgtgccataaatcttcggtaaaagaacacccccaccagcgtggtaagaacttccgtcaccggaaaagtaaaccagaaataattaagtcccagacgggaaaacaaatatccaagcggtacaaacagaatcatcgtgcgcacgacggtaagaagcgaacttttgactgctgcaccaaccgcctgaaaaaataccggaaaaatcagggaagtaaccatcgggataaaactgattcccacaaaatgaaacccaacggttccaatcgcaatcacctgtggatcactcgtaaatacccgaagcatctgtccaggaatcagattgaaaactaacgtcccgataaacatcagccccattcctcccacaagcgaagtggacaatgttttcttacagcgatccatctgccccgaagcataattgtagctgatcaccggtacaatacaggtctgcagtgcgcccagcgggataaagaaaaacgactgccatttgtaataaagtcccagtgccgtgactgcctgatctgaaaatgttgcaaggatcagattaagtccgagaatataaaaagtatatgccgactgcattaaaatattggggattccgagcttgtaaataaagcagatacctttcggatacaccgaaagctggggcgatttacgaaatccttttctcattacgataagagccgccacaatctgtcccacaaccgttgcaatggccgccccggcaattccaagctttggcagaccaaacataccaaaaataaacaacgggtccagtgctatattgaccaatgctccgacaatctgcgcaatcatcggtgtccgcatatctccattcgcctgtaaaatctttgtccagatactttctgtaaacaatccgatactaaatacacaaacgatccgcccatacacaattacattccttatcacctccggcgaatcggtagacatccgcgcatataccggcatgcatacaaaacacacgaccgcaaacagtgcccatagcaccagagtaagcggggttccgattcctccatattcatttgcttttttctcatcatgcacaccaagataatgtgccattgccgtattgatcccgactcccgttcctacagcaatggcaatcataagaagctgcaatggataaataatggaaagtgccgtcagtccactctccgaatattttccgacaaacaggctgtcaacaatattgtaaagagcctgtatcagctgggcgagcatgaccggtggcgcaatcttgagcagaatcctgctgactttttctgttccaaaaaagttgctgtctgatgtattcataaaacaaaatcccctgtgaaaattcctatttccacaggggattttacgcccgaaaatcatacaagtcaatctgttttttccatccatttacaccagcctgggatgctttttcttttctaaaatttatacatgataagcatacacccgtgcttcatatgcttgcagcatttcttctttctgtttggaataatttccgatcaaaagcttggcatctgcaggaatctgctccgttacttctgccggaatggaaacttctttttccgtaaaattacaaagcaccatcagccgctgcgtcccgagcattctggtatagataaataatgcctcatcctccggtgctaacagttcgtaatcgccataaacgataatctcgttctcatgacgcaggcgaatcagttttttgtagtacgaaaagacagaatccggatcactgacctcctgttttgcattgactttaggatagttactgtttaccttaatccacggagttcctgtggtaaaaccagcatttgcactgtcatcccactgcatcggcgtgcgcgcattgtcgcggctgatcctctttaaatatcccatcatttcttcatgagatactccacaggtttccgtcagttctttgtaagcattcaggctttcaatatcccggtaatcctctaactgatcaaaataagcattacacatgccaagttcttccccctgataaacatatggcgttccctgcatcatatgcagacaggttcccagcatttttgccgaaatttcccgatactgttcactgtcatttccaaaccaggaaaccgagcgcggctgatcatgattggataaaaacaaactgttccaggctttgccttccagtccggtctgccatctggataaaatcttcttccataccggaagcggcatcttatggctgtcccatttaccgtaatggttgtctgcctccggtccgcctccggtatgttcgaactggaaaaccatgttcagttcgctgccatctgcattggcatatttttttgcctcttccagcgtcactccggcagcctcccctaccgtgatcagatcataatgggaaagcactttccggttcatttcttttaaatactcatgcacatgcggaccgttcgcacaaccgctgtctgcgtatccggtttctcccggaattccatccggcagtccttccggtttggaaatcaggctgatcacgtccatacggaatccatcaatgcctttttcacaccaccagttcatcatctcaaatacctgatcccgcacttttggattgtcccagttgagatccggctgttttttcgaaaacagatgcaggaaatacatatctgtctgtgggtcatatttccatgccgaaccactgaaacaggatccccagttattcggctcttttccgtcttttccttttctccagatataaaaatcgcggtatggattatccacactctttctgctttccacaaaccatgcatgctcatcggatgtatgattgacaaccagatccatcatgatcttaattcccagctcatgtgcccgtgcaagcatcctgtcataatcttccatggttccgaattcttccatgattgcctgataatcgctgatatcatatccattgtcatcattcggtgactgataaaccggggacagccagatcacatcaattccaagttctttgaggtactctaatttttctgtaataccattgagatccccgatgccgtctccatttgaatccatgaaactccgcggataaatctgatatacaaccgcttctttccaccatgccttattcaataccgtatcctccttgcctctctcatatttgaatacctgcattatacggcatttttacggaattttctttcacattactgcgcaaaaataaaacaattctgccctcatttcctgcttaaattatttttgtttcctccagctgctcggtaaacgcttcgttcatccggataatcggtttacgaagtacaagtcccataaaaagtgcaatcaccaggaagatgcccagttttgccagatctatccagtaatcgttcccataacagcctccaaccgattccctcagggctgccatactgtgcgtaaacggcagaagcggatacacagcccggaaaaatttcggagcacattcaatcgggaaagttccaccggttcccgcaacctgcataacaagtaaaaccacactgcctgcttttccgatatctccaaatgaaaccgtcagcgtataactgatcgtgacatagactatacttgaaaaccagcacccaaataaaaacagaaacgtatgcgcacactgaatcccaagataatacagatctcccagtgcaatcagcgtactctgcaacagaccaaggatcagaaatatgatccaacgtccaagataaatttcatgaattttgacatttttcagtcccatcttttttatgctttcctcggaaacggtcacttttaacatcgcaaccagcacgattccgccgatccagatagaaagtgtcgaataaaacggtgccatggaagaaccataattatcaatcggataaattttcttcgtattcagttccaccggtgccgacaggaaagcactgactccggacttattatcatagatcatatgttccagatccgcataatccccgttgtcttttgctttcgtgagcttatccgtaatctcttttaatttatttgcagatttgcgtaaaagtttaccggaatcacccagacaggtctgtatttctgacagatccgatcctgcagtgtccgttaacgtgtaaacaccctttgcacttgcattgatctgtttcgtcagacctgtaagatctgcagaggtatctccgaccgaatctgcaagtttctgcaaagttccttttacatcattttcatattctttgctgatctgctgcagacgtttctgattttcttttacaagggcatccaaagctttcttgtcagaaatcagacctgtagtggacttcttcatggaagccgcagtatcggtcagatcatcccgcagttcttcctgtttttcaatagaacggttgatcttttcaatcataggccctattgaggaatcggtttccggatgtttttccgaaagcctgatcagatgatcccggagtgtcgtaaatgacttgatgtttttatccaccgtctttgctgcttttacaagggtatccaccgtatcctcacttccatttattccatcttccaccgtctgatccaaaagcaggctcatttcagaatataccttttggcctgctttcagtgctttgcccacgctctcggtcgcactgcttattgtcgctttcatatcggtaaacgtctttttggaattttccaaaacctgttttccatccgcagactctgttttcagttcttttaaaaaatcagaagacgccgtcagcagggactgggcagaagacgtaatccccgaaaaagtttccagcgtggacgcaatcatatccatgtcatccgatgcatccccaagattgtggatcagattatccaccagccggtctgctccgtttgcctcagccatattagagaccgactgaaacaccgtcatcgccgtgtcggatattgtctttataaatacctgattcacctgtttctggatcgcggttgcacccttgtcggtcacttttggtgcgatcgcattttccttggcattggaatagtaaataatttccggcttttgaatctgatcggaaaacagactcatcatctgggtactgaatttctccggaacaacaatcgccgcataatattgtccggattttaccccctccattgccttttctttgctggtaaatacccagtccatctgtgtattttcccttagtgcggaaatcacctgttcccctacattaatctcaaggggaatcagacttccggtatatccctcatccacacttgccaccgcgacctttaaatttcccgtattgttatacgggtcccagcttgccgcaatattaaaccatgcatacagacacggaacgacaaggacaccgatgacaacaatcattgcgattacatttttgcgaatccgtttcacgtcgtcgatgaaaattttcagaatgtttttcatttgctgttctcctccttcaaaattttcatcagttcctcagaactcatctctcccaaaacagatttctttttcatctcttcatgcagatattccacaatcagcagatacagaatcagtgcaagtaaagaaacgatccacaaaatcagatagaccagtttggattccaggctaaacatcaaaatcagaaatacgagtggtataaccatcatacagataaatccggagcgtaccataaccggataatatttttcaaacgcgagtgttttctctgttaatttctttctccacgcatcatctttcataatcacctgcataatccgctgcagctgtggattatccctgcccttggaatccgtctcacagatcatcagatcggtttctgcaagtctgacatcaaacagatgattcagattcatcagaagcggacggagtacaagcccgataaacaatgcgaccagtaaaaataccagcagttttccaaggctgcttctataagtatgatgatagtatccggcaatacattcccgcattgcgctgatcgaataagaaaacggaagcagcggatgcagtttctggaaaaattccggcatcatttcaatcggatacgttccggaagaacccggaatctgtaaaattaccagaagaaccgccagtgcttttcccatgtgtttaaacgtcgatgccagtgcaaagatcagattcacataaacaaaagaagttaacattccggcaagaataaattttaccggatgcagacactgtactttcagcagaatgatatctcccgcacatacgatagctccctgaatcagtcctatgataagaaacagcagaatacgcccgaaatacgcacttgtcggtgtaaaatccggcacttctttgtcccggtctacttcctgtttcaaaatagaaaccagtatcagtccacctacccagagtgccaggtttgtataaaacggggtcattcctgttccgtaattttccacttcatacaggacatccgtctttatgtttaccggagaagacataaaattggaaatatctttggcatcaatcttttccagtgacaggatattctgatacatatccgaattctgcagtgtctgcagatccgtgaccgttttctgcagtttctgatccacctgtcccatgacattgcccgtctgtgtaaatactttggagctgctgtgcaatgcagattttaactgatccagcagatctctcatctgttttgtcatggatgttatgctatgtaaggttgttgacagatctccgcttatatctgccagaccttccagtgactgatccagctgcgggtaaatatttttgctgaaatcaatccggctgttctgaaaactctcacggttatcctctgcaagcgtttccagtgaacttctcgtatctttggaattctttaacactttccgcatactggtatttgcacttttcaatgaatttaccaatttctgcgcagaaatgctctgcgtctgcagctgtgaaattttctgtccgacagatgctgataactgtgtatcttttccaagattctgatttaacttttccagatctttgagaagctgggcatttttctcattgatccgggtgatcgtatcgagactgtccccaaccgcaagatttgccttatctgcctttatctcaaacttattcagactcttagaagccgaggacgaaacttcatccagaaaaacttccccgccgatcagcccattggagaactgtttataaaattttccaagtgccgtctgacttttttccagcaatgcagaagtttcttttaaagaagaagagctgtcctttgctgcctcatccacctgatctaaagactccttgatttctttgatctgtgcatcggatttatctacttttttctgaaattcttttaccagcttctgataatccgttaaattattctgaacttcggtaatggcagatgtcagttccgactgtgtatcgtccagtcctctggtaatactgtctgcggaagactttacaatttctgatactgccgaagatgccgtggcggaaaatgtgtcgttgatctgctgttgcaccgttgtcgcaccggtatccgtaatctttggtgcaatggcatttttcttttcattgacataatagtccagcttcgggcgtttcaggtctccggagagaatacttaccagggaactactgaaattctccggaatgacgattgccgcatagtaatctcctgcctgaacaccttcttttgctttctcttcactgacaaactgccagcccagcgacttgttttctttcagtttttcaacaatcgaatcgcctgcattcatcgtgatcacgtcggttttggtccctgtatcgcaattggcaattgccaccctgattcccgaagtatttgcatacgggtccatgtttgcggcaatattaaaccatgcatacaaagacggcaggagacatacgccgatcataaccagtgtcgcggcacggttttttaacagacgtcgcacatccctgcggaaaatctgaaatgctgtcttcattcattacctctttctattctcagtttcttcatgaaaaaaggaaaatggctttttcagccattccccttttttattataaagagttctatatgaatgttcaaccgaaacttgaaaatacaaattttgatacctacaattctttaacacctaactggtattataaagtgttacgataaaatccgcaatgccttgattttactacagttttggcaagtgagctttcccttagactttcccttatgttatatccttttcccttgtgttacgacacctcataagggcaaaaacaagggaagcaaaatccggtaacagctaataacattatataaatcacataatcggctggaactggtcaagatgcttctacaactgaaacagataagagaaaggactttgcaatatgaatatcgttcatgcagaatataataaatatcacaacatcatagacatcaattattacaatggctacatacttcggattgactgtggcaaggcagaagatggattgattactactcctaactctcaacgaatgttggatgcactggcgattgacaatccactagaatatgcccgtttgtatcttgattcagaaatgcaagattgggtgaatgcgatgaatatggaatggtatagcacttgataaaagaacataaaaatgagaagaaatctgtcaaaagtatttctataaaatacgatatttctttagcccttccataaataatgaaatagagccgataactcacaatcgaaataacgagtgattcatcggctctatattttatggttatggatatcatgagtatcgctttatatgcaattgctattttgttaattcccaatatttatgacccataaagaagattgttaattcgttttgatctacttctatctcaaaattcacgctattatctctctgttccacaaaaatcatatttgaggaagatatgctatataatgcattgccacaggtaatacccaattcgggcatatctttgtttacaacaagtcctccattttcttgaaaggtaaacacttcctctgcatttgcattcttccatgtaccaataatattttttttattctgaatgtgctttatttttccaacacatacaacgataagtatagctacacttacaattaaagcaatgcctacaacactctttgccaatttctttttattcaatttctattatctccatttttagtttctttaagattgaatgattccatattgcttaattcagtatctccatgaatttctaacattgatacgcttctcacaggaaatagaataggagagattcattcataaataattaaatcattcatacttacctgaatttgtaatgtttttccatattttctcataattatctactatagttttttctgaggtcaaaaatgcaaacatagatatacttgaatagagagtttccgccgaatcaaaaaccacacaactttcatcatgagttagatttctctttgaatatatttccgatacaggcataaatgaattttcttcctctttggtgtatttatacccatcaatacatcctagattttttaaaaatattaaataagtatcttcggtcttcagatattgccatccgttagtgtaaaattcttcacctctaacaaatgatacaggttctataatgtaaatacagtcacctactgaaagattagcagaattatccttatagatttcctctatttttaccattgtttttgttgatcgtaaactcatttcacgagaatttgttacagttatacgagctattaaagaagaatctttttccatatcatccaatgagtaattactttcattgttaaagtaagaagttttctgccctcctgtatagaaaatttccatagctgtattttctgataaagcaatatcaggatcatgaacccctgtagttgtttttatcccagtctttccatagaataaggctgtcaccatacaaatgattacaacacagatagttaatacaaatttcttcattacatcaactccttaattttaccaaattccatgcatatcttctcatccgctaatatttcaatatcttctttattatggcttgtcagtatagtaatggtatcattctttttttcttccaatatacgttcacgaaataaatcaatgctatgctgatccaatgcgttagttggctcatccaaaagcaaaatttttggatgttccatcagtgcttgacaaagagctagtttttgacgcattcctaatgaatatttatttacttttttctttgatttgggatcaagaccaaagtatatcattatttcatatatttcttcatctgatacaattccttttatattggaaagcattttcaaattttcaaatcctgaatacatactccaaaaagaaatattttcaataacagctcctaaatctggtaaaacatccatatctttatgtaatgccttgtgattatattttatgtatcctttgtctgtatttataaaacctgcaatggctctgagtagcattgttttacctgaaccatttttaccatatattccatatattttaccagattcaaatgtataactgatatcatcaagcactttttcacctttaattgactttgaaatagattttacatataaattcatggatatcattcacctcacaatatttgttttttttcgcaaagaaatttacctatccacaccaaaacagcggatgatataactgaaatgagacagcttgacttaaaattcaataaatctatattgcttgtagtccattcgtaattttcttcgacataatatataataagcttgttatgccaattaaataaaggaatatgtagcaaggaataatgccaaattttccatataacatttcccattgaaaaataaaatccacacaccattactggaataaaaaatacaataaatgcaacgatgtatcctataattgaatctttccaaaatgaaaacaaataactaatcatttgcaaatgaaaaatctctatcaatagcataaaaataactttgaaatcttctaagccattagaggtatgctctacaaaaagaaaaaacaaataatcggaaacaactacaatacagtcacgtaatatcatttttattaatatatccttataaattatgtgttttttcccataacgaggaagtagaattaccatgttatcatttgcatcattaaataagtccattgtaagataacaaatctcaaggataaacaaaatcgcaaaaaatgataaagatataaggtcaaacgaatgatctattagtattcccccaaaatatatttgtgaacgtactccttctgttattgtaaccagactattatgaaaccccaagtacacattagcataaaaatatctaattacaaatgttataagtgatactagtaagcattttccaacattaacattcaaaatttttttcttatataacttcataattttttatttttctctgtataatgccaatacttaatccaaaaataagcaatatcagaacaatttctcctattatatttccatgaacattaggcataatataaccttgtatagagaattcatttagcccaaagacagaaacaatcaaattaaaaacaatatagaatataaacaaagcaccaggtatctttgcgaaatatagaactttcattttgttataatatgaaagagcataagctaagatagctaatcccgagccaaaaattccgtaattaaaaatgtatattagattatataaagttggatgttgcaatctcaccatatcaagaaaattgtcagcgttatatgataccaaacctatagcgtaatcaggttctccccaagcactgtcatatccatgtattggatatgtcaagtggcataataataaatttatgagcattggtattgttattgtcaaaaaggttacaatcagaatgccaaataattttcctgctaaatatttctttttcccgattctttgaataagtaggattgaactattgcttttttcttctcttattaaggaaagtgatgcaataattgttgcataaacaggcaataacagatacattatatatggaatatatgccgcttcagtgccctgtaatacgaaattttcatttgctgaacgaataaattgataactttttcctatatcattttttacacataaaatatacgaagcaatatttaaaatcattagagcaataaaaacaactttatattctgcacgatcaatacaatgtttgatttctataagaaccatttttttcataatctttaccaaaagggcataaacccacgaagaggtttatgcccatcccttctgttatctaaaatctacatttccacttacaaatgcagttgataattgagattgataattttccattcccataccgacctgtgtgttagtagaattataaccgctcttggtaaagattaaattacaagatcctgttccaacaccctgcttatacttattagatattttactcttgctgttattgacagcccagaaatttgcgtaagaggtattggtaattgctgttacctcatttgtgatgtaatcatcggatgttgtttttgcatgcatagaggtaaagttattagtcttattcagtttaagtgcataagcggtgtaagatgccgcctgagaatatgctgctgaagaaagaaatacacatcctgcacaaaacaaaccaatacctacttttgcaatcttctgttttaaactttttaacatcatagtcaattcctcccaatcttatttttttaactgcgttggtacttttggttcatacaacaaaccacggcacaatgaatttgcattacttcgagcaatagcagtcactgcctgaagtacgagacgggcacttttctggggtgccttgtttacttgcttattgtccatcgttttcaccccccccctccttaattgtctgacaattacagacaactttatttgtttaccatggtatgtgcttaatataacagagtatttaattttttcaatccctctatgcacgaatggtagcccaacatgcacgaactgttctacatataggtataaaaccgaaaagatggcagataggttaagcacctacctgccatctttaatctatatatttcagaaataatgattaattattgtcagtctcatatatagatttataacgctctcgatcaactggaataatctcattatcattagcatctttatatgtaataaactcatcgtattctgtaactgatttttcctctgagacagaattaatagaatacatattcgaatcgttacacattacatttgaatttggaccagaaattagtaacgaaccatcctcttgtgcatatgccaaaaagatataaatggaattttcggaaggcagtgaatcattctcaaacagataaatagcatcttgtttttctgaaattccgccttgtttaacaataggaataggtttatctgtaataagttcaccttttatattttcgagaacctgaatagtataattagtgtaaggcgaaccgacctccttaggatttcctttttcatcttcagtcgttataacatttcgatactcggttccatcgcaactgacaacctttgctacaaatacgtaatcacagataccaacagcttcgcgaatgttatcagtatcatatacaaaagatgcgtgcatctggtggattggcaagttagatacatttgtattcagttgacttgcattatttttggatgcacatcctgtaaaaaacattcctacgataagaacaatagacaaaataccatagatacttgattttttcatagcgttctccctcccctaataattattatatgcggcatcatatgaatctttatcattttgagataatgcctgcgtactagtatgtcccgtaattgctgcatccataacatctgttgaagtactgtgatccaaccctaatgcatgtcccaattcatgtgtcgctacattctgttttttactattactataaccgctcatataataggtattgagttcaattttaccactagaatatgtcatgcctgcccatccattcgaagcattgacatcgcttacgtatacatcttctacaacaaaagcactgtcttttctgattactccagatttatatgcattccatgtggcagccccagtgttaatataactcatgtaagtgctgtttccgtcatagtctagatgtttgccagaatcaacaagatcccatgtttgtacataagcttgtgcaaatgccgtaataggaaatagcattgctatagccattaaagttataatgctatacaataaatgatttttaaaacagattttttaaaatgcatactccttcactccttttcaatcatgtaacaacggttatcttcaattattcttaaaggttatctttatgaaaattgaaacgcaacacatactagtacacattatatatcctgttaatattcctaaagtacgacatcttatcatctccactccatattatagattctcagaatacttaagatgtagtagtataccttgaatataacaaaatctttatacttttcaatacctctatgcatgaatggtagctcactatgcacaaacggtagcatattatgttgtgtacctactttattgatgataaaatatgacggagaatgattaaaggaagtggtagctatgctatatattgactcaatatgggaatatattgttaatttcttagaactggcattgtttataatatttatccataaaaaattgcgtattcgagcaaattataaacatcaagcagttttgatgtttcttttcgtatcatttcagtttgctgtgttatgcacgctgaataaaatgggaatatcatcctacagcactttgatgtcatcttgtgttttggacattggatatgcagtattgttctatcgtgatagtataattcgccgtatcttttggggcttttcgtattccatcatttgcttagttgcagaacagatttcgttctttattcccgttactctttttaaaggagcgtctctggagctattattaggtggaacattacggaagccatataccatgttatatttggcaatgatagctgtttttgtcttgttatttcattctattggaaacaaagacatatctctttcaccgttccaaaaagttgcatatattttcatcgcaatttctggacttgcaatcgggcactacatattaaggctgactttggaatctgttgataaatttggtgattcatccttttcagctaggctatcattggttgacttgttttttattattttatttttagtattgatgctatacatataccagctaggttattcaaaagaagaaaacatacgattactggaagaacaaaagatttatgggctggaaaggactgagttcaatagcttatctgagacaactgaacgattacgaaaaatgaaacatgatatgcagatttatgtggatgcaatcaacgtattagcaaaagacaagaaatgggatgaacttatagcatatacagagcaataccataacactcttgcaactacgcaaagtgccatagcaacgggaaatattgctattgactgcatacttaccgcaaaacttgattatgctgaaaaacacggaattaagacagaatattctattatggctcctgaaaattttccgcttgattctgttgagctttcatccatacttggaaatatatggaataattccattgaagcaggagaaagacttataatctctgatccaaccgagcatccatacatttatttttatattaaaccttaccagaatatgatactgattcacattgaaaataattatgatggtgtgataaaaggtagcattgatggagacattttgagtgttaaacaaggaaaagaacatggacttgggataagacgagtaaaagagcttgtagaaaaggcagatggcgtattgcagattacatctgataacaaaattttttccgtacatattatgataccggataaggagaataacaaactactatgaaaatgaaaataaccatacttgaagattctgtgatcgaatcagaacggctgaaaaatggaataagaaaatacgggcagcaatatgattgggatattgaaattgacgaatacgaatcgggcgaagaatatttttcaaaaaattctgaaggcacaactatacaggcttcagcatttttccttgacatacaaatggggcaaatgaatggaattgaggttgctaaacgccttcgtgaatctggttatcaaggtattattgtatttttaacagcttttagagaatatgtattccgaggatatgaagtcagagctttaaactacttgctaaaacccgtcaaggaaaatactctttttctgtgtttggatgaaatcgcgaaggagttatctaataatacctacatataccgaaacaagcaggaaattgtaagtattccctatgcagatatattgacattttcgagcagattacattatgtggatatattgaccgtagacggcaaatgctatgaacaaatgtctaccctaaataagattattgtccatttgccaagtgaatttatccgaacccatcgttcttatattgtaaatatggcacatatctatcgtattacatcaggaacgattgaattgtcaaatcatctaactacacaaatcgcacgttcttattccaaagacgtgataagtgcttttgccaaatatacaacaagatttgatacaagcggggattttgaatgattacgaagtgggctacatctattgctaataagttagcagaactatccggggaggatgtttctgcggatcaattagaaatatacatatatggcttagaatgttttttgaatacttttataaccatagtgttattgttcgtatggggagttttatcacatacactcggctataccctaatttgggtaattaccttttcattgttacgacattataccggaggtgcccatgctccaacgcagttaacatgtatcttaggcagcttttttctcggttgtcttgataagtgggctataatctatttaaagccaactgtactaggatatttgatacttgtccttatgtgtatattatttgcacctataagtaaccataaaatatgtttaaccaccaaacaaaaatggatacataaacttatttctgtgataattgttagcattggatttctgctgttttataaaattggaaacacgaagatgaataccacattgttttattcctttttctgcgtaatcattcttatgatagtcgaaacaattaaaaatctaatgagacactttaaatagcaggatgacttttcataaatattcaaaaaagataaagaatttgatggtctttatcttttttgaatttaattagattatctagctcctctgtctgatggcgaacgatagttaaaatctctgtcctgttcccgtttctgaacttctgcctgtttttctgccagctttcgatggattgagttttctccatacttggagttccattccttgtttgctttgacataggattcatactcggacttgccttgtttatagacttgcaggaacgcatctaccgttggatatttgtaatcctgcacgatatgggataatccctgcttcataatcttaatcgtttctgcgtatttgttagactgtgcctgcaattcctttcgtttctttccttggaataatcctgtacagttcttcaaatcctcgtcaataaggtcttttttcacttcctgcgtatgaatggctctgttttgtcgtttaagtttctccataatctcttcaagtcgcatctcataatcgtgtgccagctcagacattcttggtcttggcggaataacggtcttttctgcggtagtagtagcaggtgctttgaatggttgggtcacagcaggaattgtctgattgtctgtctgtgtaacggatggagctggttgtttctcttgtttttcatttcttcgctccataaggtcggagattctggctttctgttgttcctgtttctgtatcagcaactttatgagttcttttaacagctcgattgcccgaaagataatcataaacaaaagctccggatgattgccatacttgtgaatggattccttaatcggagttgaaatctgttcctgctttacctttaagatttcctttcgctccatccccgataccaaagcgtgatccacagtacgattccagtcctgtatgaccttattattgagtgtaatcttatctgcctttggattgttcttaccgattttcttagtggcaagatagacatccccacgcttgaatgcagacagcttttctttctcatctttgacaagtccgttgatgacatcggtataaaataccttgacctcatctaagaaatgttcctgcttaaagcgagcgtccttgatggtaaacatctgtctttcgtagacctcacctttcttgatcaccttacaccttttacggatagttccattctcgtctaggatttctttcttggtacgaacatgattacctttctcatcatagaacatatttctggtggcaatcttttctatcggttcgtcaagataatttcgttctgcaaagataagatggatatgataattcgtctttcgtttgttatgatggagtgctgcaatacaatcaacaccataccgacttttgaatttatccgtcatatattttaatagtccgtctggcggataatccacaaaggattccggcagggcaatgataaattctcttgcttcgatacattttccctctgtaccgcttttcttaaattctgcctgattgcacttggcaagttctgtccaaaattttcggtctgtggtttcatataccgcatagagattttcctgttttttgtcactggagatataatagattcttccacgaacattatggagctttgacatctgcacaaatgaatttcttggcatagcgatttcctcctttcccagttttgattttggaaaagaggacagataagatagatgagatgtgagtagtaaactttccctgtgagcgagtgcataggcactcgtcttgcgaacacatccgccttgtggcggctaagcctcgcagagcgaaatacacagagtacaaaacgaagttttgtgcgatgggtgtatttcgctctcaaacgccgagggcttgcttatgaagttcacttttagctgtaactgttccctcagcacctaattttgtgcctttaatggcacactttttatgtgccgtatccggcactcccttttcttaacagaaatgctagaagattgctatgaaaatcagcgaaacaatagacgaatccgttagcacttttgccttaacaatagcattgttctattattcagactttttagcaaaaaccgtagaaacagtagaagtctgctattaaaatcgaaaaaacaatagcacgattcgttagcatttttgccctgacaatagcattgtgttacttcgcttacttttaaactgtgtctggcaaggaagtggtagtaaaagttcctattaaatttcatttttaatagtgcattgttttattacattttgattttaatagagctttttactattaactctttgaaaatgtaccccatagattggacactcaaaatcatagtagcgtacactttttgtcataggtcggacagcttttttcatagctacacttggtatgacttctcacagcactttttgtaagttgggtggacttgtcctaccagtcggcttcacttgggtggatggttgcacccacttcattttctggcttgggtggactattcataacaccttttgcatcttgggtggacttgtcctaccaacaagctataactgggtggacgattgcacccattcacatccatcttgtcctcattttccaaaagttctggttgtatctgaggacttgtccgtgatataatctatttgcgtgtaggtatatcatggcttttagtcagatacataccagagggatggtcttaggactgtcccttattcatttttcattgttcccttgaccgcttttactgcgtgtctgtctcgtaaatccttcccctcattgagaatcagaaactcgtctaatcgttccctgcggattaagatttttcttcccactctaaggataggcagcttttcccattccacaagatttctaagagtgtttcttccgatacctgtatagtcggcagcttcttcaatggagagagcaaactttaattctgtcattcgatcacctcattcctgcgtaggattacaagtcttgtatatcagaggatgttcctttttgaagaaaggattagccttttttaaaacttgcgttacgcaattctgattaaagtatatatcttttataacgctatgtcaagccttacgaaattctatcatcttttatagaattgcgtattgcaatatatcgtgttatgtggtatagtaatgacataccgaaaaaggaggttcgcaagtatgttaaaagataaagaattgcgaaagacaatcggtagcagagcaaaaagccgtagacaggagttaggattgaaccagccttatgtcgctgaaaaaatgggcgtgacagcctcaaccattcagagatacgaagcaggaacgattgataacaccaagaaaatgaccttagaaggtctggcagatgcacttcatgtatctgtggaatggctgaaaggtgagacggacgaatacgaaacagacattacggataaaagagaattacagattcgtgatgtgatgacttccattctgaataagctcccttatgatatggaacagtccgaaagtgatttttccaaagacctgctactactgatgttacgggaatacgagctgttcgtggattcgttccagttcgcttgtaagaatttcaaaggaaatacagataacaaaatgctcgcccagacaatggggtttgaatccaataaggaatacaatgagattatgttccttagagaaatcacccacaccgtcaacgcattgaacgatatgggcgatattgtaagactgtattctaagaatcctgagacagcgaaaaatcgactagccaatcttttatcagaaaaagatcccgattcggtatagataggcagacggagctatgatatacttacacgcaagaagcatttcaccagttccgattgccgatatcgaaaggggaaacgattatggcaaaaggttctgtaaggaagaaaggcaagaaatggtactaccgcttttatgtggaggatgcaagtggtaacttggttcagaaagaatttgcaggtacggagagcaaatcagagacagagaaaatgttacgcaaggctatggaggattatgacgcaaagaaatttctagccaaagcggacaacctcacactcggacagatgctagatgtatgggcagaggaagatttgaaaacgggttcacttagcaacggtacagtcggtaactatttacaggcagtaaacaggattaaacaacacccaatcggaaacagaaaactaaagacagtcacttcggagcatttgcagaagtttatggatttacttgcatttggcggtgaggaaggaaattttaagtcaaagggttacaccatcgactatatccgttctttccacgcagtcctgcaacagtccttccgatttgcagtctttccaaagcagtacatcacattcaatccaatgcagtatgtggtaatgcgtaggaaagccgaggaagatgtggatttgttttctgataatgatgaggatgcagaggttatcaacccgattacaccagagcagtatcaaacgcttatggagtatctggaagaaagaaacaagcctgctgtcctgccggtacagatagcgtactacacaggtcttagacttggagaggtatgcggactgtcttggagtgacattaactttgaggaacagtatctgacagtacgaagaagtgtccgttacaacggagcaaggcacaagaccgagattggtccgacaaagcgaaagaaagtccgtatcgtggatttctgtgatacgctcgctgacatcttaaagaaagcgaaaaaggaacagagaaagcaggtattcagttacggagaactctatcagaggaactactacagggaagttaaggaaaagaatcgtatctactatgagctttatcatttggatggcacagaggacattccgcttgattacaacgagattgaccttgtatgtatcagaccggacggagcatacgaagcccctgcaacggttgagacagctttaaggacagcaaggaaacgattgtcggagcttgatgataatttccacttccacaccctgcgacacacttataccacaaacctgctctcaaatggagcagcaccaaaggatgtacaggaattacttggacactcggatgtaagtaccactatgaatgtctatgcacacgctaaccgagaaggtaagcgaaactcagcccgactacttgataaggtggttggagaataaaatcgaataagaaaaactttcccttgtagatacctcataagggcaaaaacaagggaaaaggatacatatagagtggcaaggcataccgccaagtcgcataaaataaggaaagttgagattttagttatacaaattataatttatgtttttggggtttccattgtattttcttctgatttctcatataatataagtaccgaattatgagaaatggagccatcccggtatatcacccagggatggctcttctgttttcattgatacctgttcactccttgagaatcgtttgcatggtgcacaatcagctgggcgaacaaatgatcaaaaatgaccggattttgctgcataccttacggcaatcagacttccaaccggtggtatcttcgttttcccacagccatcaagcagaccgcagccgttccactgcagaataacacggcaaattcatttcctgcaaacgacaggcacagatcattttccataaaccagcctccgctggttgcatacagtactgtgggattaaataattcccggataagatcccacacatttcccatctgcacataggcaagcagatatgcccccataaaaagaagacccaataccgcaaacgaaaaataactgttctgtaaaaacaactgcactgcggcagtaacagccgcaacgatcccaagcagtcccacaagcaccaccagcgcaagcaaaagataacgccactgctccagccaccagaacgtgacaaacggatacatcatctgcagccgcggctctgcaaccatacatgccgccaccggaacatgccacaggttctgaaacggaaccgctgcaaaaaataccaagagggtaaacactgtaagcagtcctgcataaaacagcccgcacaacgttcctgcaagcattttcttttccatcattttctttccggtggtggtcgctaaaaccagatcctgcgtcttatatatcctctcataatccatcagatacagcatcgaaagaatcatcagaaccgcggtctgcaaaatcagcttcttccacagttttccatacaaagtggagtgcagtttataccaacttcccggataaaaggcatacgtgccttcccctgtttttctgatctgttccacccgcttctgcaacctgtcataattgcgcacaatccacattccccaggctccttgcggttcatatccactctttttttctttctgttccagaatcttacgcatatccagtgtatcatacattccgccataggtctttttatagtccgcataggcactttcatactccgggcttgccgtctcctcatccgtcacagccacatgcatctgccgcagttcctttctcatgccggcatttcccacataggtatagatactcaaaaactgaaacagcccgaatgtgatacagacaatccacagaaacggatgccgcagacattttccacactctttttgcaaaaggcgcattctttctctcctttacactcatctatcgtcagagatctctgtaatgatccctgtgcattttccaccacagcacgcacgcgcatgccaaaatccaccccagaatccaaagctcttctgaataaggcaggctattttcatccatcggcttctgaaacagatgtacaaaaatgtgtgtcagcaaaaagccaattcctgcgcatgccggaatggcaaatgcaattcccgcaatgtaattgcctgccgttcttccgatcaggtaaatcaaaacaaccgcagccagcacaaacacaaacaccagcagcatgtaaagcagcatatagaaaccaaatggcagatttttacaccacaactgcagtcccgtatcgtcgatacaatcgcctttccagaataccgccagtccttttatgacataaaccagtacataaatatcaaattgtacgattcccacaaaaccgcagcagcccacaagtgcctgaaactgtctgtcaaaaagtttccgcccggtagcagtcgttgcatacaacggcagcacatgacataaccgttcccgtaccagatacggcagtgcaaggattgcaaaacaaatcagaagcagaattcccatcattctcatatctttttctacaatataaaaaattccacccggcattagagagatactgtctccattctgtaaatttttgtattcatccagccgatcgagcacctgaagttcaaaaaacagttttgacccttttgaatcctcaaagaccagacgcgacagttcctgatcgattttcttttcctcatcggttaaagtatccttatcaaaaaatgtttcctgtgtcttcgaaaattcctgataattcgtaatttttgcatctgcaagaacctgatccgccgcaatgatccgggtatatgcctcttccagttcttttcttttttcatccagcttcgaccagtcctcacgcggcagcgaagttccccagctttcgatcagttcggcgtaaaacggcatatcatacggggaatctgttgtctgccctcccgccggataaatcgtcacttctaaaaacaaatgataaaacagcaccgtaaatactgctataacaagcaatacccggatatccatgatttttttacattcttttatcaatattttcatgccggttcctcctgataagtaaccagaaatacatcttccagattcggcgtacaattcctgctgccttcctccggcttgctgctgtaataacgcacctgcatatgttcctgctcctgccgcacagaaagaatcagatgcgtgtcttgaaatgcatcaaacgcacggtcttccatcacgcactcatacacctttccatcaagcgttttacaaatattggaaaccgtgtccatccggtatagtttacgttcttttaacagaatcacctgattggcattcgactcaatatccgacacaatatgcgtggaaagaatgacgatccggtcctttgacaacgttgacaggatattgcggaagcgcgcccgctcttttggatcaagtcccgcagtcggttcatccagtatcagaattttcggatcatttaacattgcctgtgcaattcccacccgctggatcattcctccggaaaattttttcatttttttgtctgccacatcagaaagtccgaccagttcaagcagttgttctatcttttcttttgcggtctgctttggcatatttttaagtgctgccagataatccagatactgcacgggtgtgttgtttttgtaatatccaaactgctgcggcagataccccagcagatcccggtatttttccccgagctttgcaacaggaatcccatcccataaaatttctccctgtgtaggaaccagcagggttgcaatcatttttatgagagttgtctttcccgcaccgtttggggcaagcattccgtaaagcccatgctccatctcaagactgatgtcttccaccgccggaaattttccgtaacttttgctaacatgcgaaagagtaagcatcttttttttccacctttcctattgatacgaacaaaagacaaaagcttgcggcagtgaccgcgccgtgcaccgccagcggaaccgatgtaaaaagaaatatctgcacgccagttcccgcaagccttgcaatcacgcacacacacgcccagactgcgatcagacctgcataaaacagaccacccgcgcctttgtggcaggcatatacacagaccgaagcaaacaaaaacacactgctgcttcccaccagaaccatactcacaaatgcttttcccgaaacatccgtaaataaagctgctccggtcacattgaccagtatcatgatcacgcctgcatacagcatgcgaagtcccgacagatagctctgggaataatgaagcgagccgatcagctcctgcatgtggttctgcgcatccagccaccatgccagcaccgcaaacaccagaaaacagaccggaaatcctaaaaacacgatgatcatctgcgtttcgggctgctttgcatatgactgtccaagccatccgattcccagatacagacaggcaactataagccagatacttccgctctgataaaatatggcacgaatgcccggtccccagtaaatttctttgcttctttcccacagactctgccgctttggtattgctttttccacaatcgcacgacattccttctgcataacgctatcctccgggaattctactggaagcagtggtatcttctgttctttcttccattccttttccttcatctttgcacctcctgccgaatcctttttaacatctggtaaaaccgggtctttacggtactctccgcaagatccatctcctctgcaatctgcgcaaatgtcttctcctcaaagcattttttctgaaaaatgcgaatccattcgcgctcataggaaacgacaatatccataatccggcgaatctcttctttttgaaccatatgctccgccagatcacgcacagttttttcctcctctgtttcccattgcaggggctgctgcagtttttcctttttataacttttactgcgataataatccgtgatcctgttggctgccacacggtatgcccaggtgcggaagcccgcctttttctcatcaaacgcataaattccctgcaaaaccgtaataaaaatttcctgtgtcagatcaagcgcaagttccctctctccggtctgccggtaggtaaacgcatagatttcccggtagtatcgccggatcagttcatccgccgcttttttatcctgttttttcttaattctgcggattaactggttgtccgtctgcatgcatgttcaccgcctttatctccgttcactcagatatacgaaatatgatacaaaatagttgggattctgaaaagatttttcaaaaacaaaaaagagccggtgcaaaatcaatttgcaccggtttccttttgtaacactttttatgcttccttccgcagttcctttgccacctccacaagatgtttcaagctggcaacggtctccggtacgccgcgggtttttaatccacagtccggatttacccagagcttctccggagcgatacgggtgagcattttttcaagtgctgccttgatttcctctactgacggtacacgtggggaatggatatcgtacacgcccggtcctacctccgtcttgaaatggttctcctttaaagaatccagaatcaccagatcggaacgggatgcctcaaacgtaatgacatcggcatccatgtcgtcgattgcgcggatgatatcggtaaactcgctgtagcacatatgggtgtggatctgtgtctgtgctttcacaccgctgtgtaccagacggaatgccggaattgcccagtcaagatattctttgtaccagtcactcctgcgcagcggaagcttctcacggagcgccgcctcgtcaacctggatcacacggataccgtttgcctcaagatcgagcacctcatcccgaatggcaagtgcgatctgataggtgctttcctttaaggaaatgtcctcacgcgggaaagaccagtttaaaatcgtaaccggaccggtcagcatgcccttcatcggcttctttgtcaggctctgtgcataaacggaccagtccacggtcatcggcttttcgcgggatacatccccccagatgactggcggcttcacgcagcgggtaccataagactgcacccatgccttctcggtaaacagataaccactcagctgctcgccgaaatattccaccatgtcatttcgctcaaactccccgtgcaccagcacatcgagtccgatctccttctggatctgtacccactcagcaatcttctttttattaaattccacataggcttcttcgctgatctctcccttgcggcgtgccgtacggtttttcttgacatccgcagtctgtgggaaagaaccgatcgttgtcgtcgggaataccggcagcgcaaactcttttttctgaatcgcttcacgctctttaaataccggaagtctggtaaagtcttcctcacgaatcgctgctacacgctcctgtaccgcattgtttctgcaatccggacgggtggcaaacaaagaggtattttccagaaatgccgtatccagtttgtaatcaacgtctgccagtttctttaactctgccagttcctgcagcttctcctctgcaaatgcaaagtgctcggtatatttttccggaagctttgtctcatttttcaatgtatatggcacatgaagcagggagcaggaagtatttaacaccacattgatgttcttcgccttaagcgcatcgatcacttccaaagtctttccgtagttgttcttccagatattttttccattgacaagtcctgcaaacaataccttatcctgtggaaaaccgtttgcttctaccagttcttttgttcttctgccctctaggaaatccagaccgattccgtcaaaagcaagcgctgtgatattgccataacagtcacgcacatccccgaaataggtctgtaacagtactttgcctggtcccttttttgcaaggattctctgatataaggtttcgaataatgcaatgtcttcactggtcagatcatgcaccagatatggttcgtcaaactgtacccattctgcgccggctgcaacaaacttctcaagcaaccctgcgtatgcagcgctcacggcatctgcataatctgtggcctgtttctttcccacataacgcaggagttttaacagggtaaatgcaccgatgatcaccggttttgtggtaatgccaagggcttttgcctctgcaaactcgtcaaaggggttggttccggcaagtttgatctctgtattatcatcgatttccggtaccatgtaatgatagttggtgttgaaccattttttcatggcaagtgccttgacatctccggctgctccctgatacccccttgccatggcaaaataggtatccagtgcagaaagtccaagctttgtgtagcgctctggaataatattgaataatactgccgtatccaatgtcatatcatagaaagaaaaatcatttgacggaatgaaatccagtccggtatttttctgtaatgtccactgggttttgcggatttcttttgcggtattttgtaattcttccgcagaaatctcaccgcggaaatatttttctgttgtaaatttcagttcccgtaaggaccccactctcgggtatccgataattgatgttttcattatgctctcctgacgtacaatgttataaagttcatccagagaagcggccacttcttttgttgcgctttagtatagcacaagtcaaatttattgcataatacgattttctaccggtttaccatagtttcaaactatatcagttttatttgacaaacgccctctggtttcatatgcttattaatagatttgtccctatttacatttgtgtgtctgatagctgttttagtcaatggttctttatgacatttacattgaatatagaaacatacatttctatggatgggtttaacaacatcaaatgttgcaatgaaatcaacgccaccatcaaagcctgccttatatctttctgggtcagcttcattaaattgtggttttaaggtaatgagtacaagcattaaccaacgtctatgaggctatttttcaaacaccaagatatagaaaatataaaatattttttagaaaggaaaatttttatagaaaataaattacagacattagcttggctgtagtctttttaaacagcatatgttagactactgttatacaattggtatttatagaaaaaatcaaacagctaggagagcatttatttatgaatagttttacatatgcattggaacaaagaaatttggaagaattaagaaagtatcctaaggcagacttgcacaatcattttgtgcttggtggaaatagaatgtttatatatcagaaaactcgtaaaaaaattgagccattagttaatcctttgtcatcaatggatgagatgaatcaatggagtcaaaaatatattgatcaagattttaatagcactgcgatgagaaaatttttaatcagagcaacctttgaacaagccaaggaagatggagtaactgtgcttgaaattggtgaagatgtgtggggcttaaatgaattttttaataatgatattgatgagttggttaatgcttttacaagtgctcaaaaagaagtcgctcccgatatagaattaaggctccaaattggattatcaagacattgtcctatcagttatttagaagattgtttatcgcttttttggggaaataagaatttttattctattgatttgtacggtgatgaattagcacaacctatcgaaaattttaaaggaatttatcggcgtgcaaaaaaagaaggattaaggctaaaagcgcatgttggagaatgggggactgccaaagacgtaagaacagcagtagaggaattagaacttgatgaggttcaacatgggatagcagcagtcagcgatgaatcagtaatccgctttttggcagataataaaatcagattaaatattacgccaacaagtaatattttacttggaagggttgcagatatgtctatgcatccgattggaaaactgtatcgtagtggtgttgatgttactataaattctgatgatgtattaatatttgattcagatgtatccaaagaatatctacggctttatgagtctcagtgcttaactgcagaagaattagaaaacataagaaaaaatggactgaaacctataattgtatagacaaatccttgtcaagtacaagagacattgaaagagccagtccattcaaggtgctggctctttcaaaattcaaatctaataaattgcacgacaacttagtgaaaaaatgaatacccattagtgtaaaaatgaataaaacatgtagaaacgaataaatattcatgttagtttaatctaataggcagaaggaacacttttccgaaaagggagatagatttttatcgccccaaaagagaaactgattatgcagacaaattttcatttatatccaccggaatacgatcgtacaacaaaacagccaatgaaggatttcgggttcatcgaatcgttaaaaatcgactccatggttgttctgatcaaagaaagctatcgcggattcgctgatctgtcactggaaaactatttttccacagatgaacaggttcttgattaccgcctcggggttgtcgaagatcttgttaacaatcccaatctgtacgaaacattcggtaaggctgtatccatgatctacaacatcaacgatatgcgccgcgcgatgagttccgaatttaccattgattcttcgctccgctctgtgcggtacctggaattatatgtggaaatcgtcacactgtttgccgataatttatcacaggctgcgctgcaatccgaaggcatgaaaaatttccagaaagaaatcaatggaattgcacagagcagcgagtttcaaacgctaagctctgagctttccaagatggaaacaaatttcggatacttaaaaagcgtaacgcttgtcatcaatttagacggaaatctctgcccgatggaagccggatatattgcaaccgaagtgctcaccggcatcggcattatcggctgctgtgggctttatgtcacacacatccacgatctgacacaacaactcgatgtctacaattcccatcctgaaaaccgcggaaaaattgacaaccttgttgccatgatggaaagtaaggaagaaggcacccgaagctacaaggtgatccgaacaaccccggatggcttaagctatgcgaaggatattgccagacggtataggctggatctggaagatattttaaagaattgtaaataaatctatggtaaaccttgtccccatcccaaattcactgtccacttcgatggttccgtcatgtgcttcgataattacttttgcaattcaacataactgcacctcctaccgactggcatacaggataaatccaagtagtccgattacagcggcacttaactatgcccgccaaaatagaaaacagcctgttggcttagaaagcacgataacactgatacacacgctccatcaaaaaatcagaggttccggaggactaaaatctcccacaaaaataccctcgaaactgctctctggttgtcctatatttaaccactaaaaattgggggaaaacgactctcatttagccaaatctggtcaaaccacatcatcccgtttatgtataagaaaaccccggaaaaccttgattttccggggtttgtaaaccttttgatatagcctgaacagtcgattaacgcttgctgaactgagaaatcccacaggacaagggtttgcagagataatgttgcatacttgttgtatgcgtagaactgtccacagagttccaaaacagctaatggttctattattcttgcaatcaattgtctgcttaaatatgctgcgtcataaaacataccaatgatataccgatttgtcactaaactatttgttccttgcaatagggaagttcatatagcgtatccggatcaatatcaatgcatttacaagcatctctatttccgcctatatcccatgctaatgtatcattcatgatcgtacatgtatcaataaataccgaaatatccctcaatggtttgaaaacttctttatccaacatatttttcatatcataacatacaatttttccatcttcaaagtagacatacactgtgtagtctttccttggtatcacttgaactacctcaggaaacataaacagcacctcctatacaagtggattaattctatttaacggctttccatcttttgataattcccaattctgcatcaactcatcttgatgtaaaacacaccacgctagaattaactttaattgtcttgatggcaaagctcccttgatgcatctagctgtatcaatttcaataattgccttattctcattatactccgcatgaaaatgcggcggattatggtcatcataatacattgtaacccgaattccataaaataaagatatttccggcatatattcacctccaaatactcattttgatctgttcaaatacagtatatcatacttattcctttttttatacaaaaactccccagaacaaagatcctgaggagttgtaaatcgtatataattgtccctaaatatgctgaatcgtatgattccaattatctctttgttaacgcttgctaaactttggtgctctacgagctgctttgagaccgtattaaacatctctatggtgcgtttttccttgatattacgggctttttcgcattttctgttgtcggttgtcctattccttaaccatggaaatcagtgatttttcatcgaaattctcctggttcaaagcatcattcactacctcgaaaagttcctctggtttattatacttgaccctcgcgtaaatgtccatagttgtcttactattctcatgcccttgaaaattgcaaagtttaattctaccatccatttatacagtggaattctcttctgcttttacctcttctgaaggcttagaacttacgccattttcagcctttacgccaccgatgctcttcattgtcgggaacagcagtacatcacggattgcctgactgtctgtcagtaacattaccagacggtcaattccgtatccgataccacctgtaggcggcataccgatctccagtgcattcaggaaatcttcatcggtgtgctctgcctcgtcatcaccggctgcggcattggcatcctgtgcggcgaaacgctcacgctgatcgatcggatcgtttaactcggagtatgcattacacatctcccatgtattacagaataactcgaaacgctctaccttggtaggatcgcttggtttcttcttggtcagtggagaaatctcgatcgggtgatccatgataaaggtcggctggatcagttccttctcgcagtattcctcaaagaagaggttgatgatatcacccttcttgtgacgctcttcgtatgcaatatgatgctcgtcagcaagcttctttgctgctgcatcatccggtacctgatcgaaatcaattccggtatatttcttgatcgcatcgttcattgtcagacgtgcgaatggctttccaaggtcaatttccacgccgttgtaagagatcttggtagatccgcatactttttcagcgaggtaacggaacatggattcggtcagttccatcatgccctcgtaatcagtgtatgcctgatacagctccatcagggtaaattccggattgtggcgggtatcaacaccctcgttacggaatacacggccgatctcgtatacacgctccagaccaccaacgatcaatctctttaagtaaagttccagggaaatacgaagctttacatcctcatttaatgcattgtaatgtgtctcaaatggtcttgctgctgcaccacctgcgtttgcaacaagcatcggagtctctacttccatgaaatcacggtctgctaagaagttacggatctcctttaaaatcttggaacgctttacaaatacttccttgctctcctgattcatgatcagatcgatatatctctgacggtagcgcatgtccgtgtcggtcagtccatgaaatttctctggaagaatctgtaaagacttggaaagcagagtcatctcctccgcatggatggagatttctcctgtctttgtgcggaatgcgtatcccttaacaccccagatatctccgatatcggatttcttgaaggttgcatacagatcttctccgattgcgtcacgcgcaacatagatctggatgcttcccttgagatcctgaatatttgcgaaagatgcttttcccatgacgcgcttgaacatcatacgtcctgcgatggatacgtggaccggatcggcatccatgatgcttcttctctcctcataatctgctttgactgcctctcttgcagctgcctcgtccataccatcggtattaactgccggtctgccggctaaaagcttctcttcgtgtgcattgtaaagttccttcacatctgatgtgtgatgggttacgtcatatttggtaatctgaaacggatcctgtcccgcttcctgcagatttgcaagcttttcacggcgcacctttaacagctggttgacatcctgctgctgtccgccctgctttccgttattctgtcctgccattttcatttcctctcttaatctacggttgatctctggatctcgagtaccttgtaggataactcgccagcctgtgtctctacggtgatagtatcgcctacttttttacctaaaagtgcacgtcctaccggtgattcgttactgatctttccctttaagctgtttgcctctgtggaaccaacaattttgtactctaactcatcgttgaactcgcagtcgagaatctttaccttacatccgatgctgatcttctccagatcgacctcttcctcaacaacgacttcggcattctttaagatcttttcgatctcctcgatacgcgcctcaatgtctctctgctcgtcctttgctgcatcgtattctgcgttctcggacaagtcaccctgctcacgggcttctttgatcttctgagcaacttccttacgctttacaactttgagattctgcagttcgtcttcgagctttttcagaccttcataggtcaagatatttttcttatccatttgatttacccctgattctatattttttatatgcagctttttgaaaaaagcgcataaataatccacaataacctaggtattatagcgaattgtccacattctgtcaagatattctccttcaaaccggactgtcgctcatccgtgaagttaccgcccgccccacaccgtgtccacccagcacctgaacagcaattccgtgaacatcgacacagctttctatgcatcagacgaaatactccatcaatagtgtctccagctgttcgtaattttccacctggttgattgccacacgcagccgtgccccatgcggatatccggcggtataccatgccgcatgcttgcggatctcacggataccgatatattcacctttaaactccagcatcatccgggcatgacgcagaatcatctgtgccacctccgatgccggcggcttcggcagatgctcccctgtttcaaaataatgcaggatctgccggaaaatccacggatttccctgtgcgccccttgcgatcatgaagccatcacatccggtctgttcttccatggcaatcacatcctccgccgtaagcagatctccgtttccgatgaccggaatctttacggcttcttttacctgacggataatgtcccagtctgccttgccggaatagaactgctccctggtccgtccatgcacggcaactgctgccgcaccggaagcttccgcaatctttgccatctccaccgcattgacatgctcgtcatcaaaccctttgcggatttttaccgtaaccggttttttgatcgcttttaccgtcttttcaataatctctcctgcgagttttggatttttcatgagtgccgagccttccccgttgttcacaatctttggcaccgggcagcccatattcaggtcaagaatatcaaatgggcgatcctcaatctgatgtgcaatctctgcaataatatccggatctgatccaaacaactgcaaagacaccgggttttcccgcggatcaatcgtcagaagtgcctgtgtgttgcggtttttatagagaattgctttggcacttaccatttccatgcacaaaagccctgccccctgctctttgcacaacaagcgaaatggcaggtcggttacgcctgccataggagctaatattaaattgtttggcagtgtcacactgccgatctgaagtggtctgatcataactattttattttccgattctgttttttatacacaagattgatcccttttaacgtcaggttcggatcgtaaatatccacagcatccgtctcattggcaatgatgcgaccaagtcctccggttacaacggttttgatgttttcaagtccgacttcggctttcacgcggttaataatatattcggtctgcccgatctgtccgtacacaagccctgcctgcatacttgtgatcgtgtcttttccgagaattgatgccggctttttgatctcgatctccggaagttttgcagcatcttcccacaaggcttttgctgaaatccggattccgggtgctgtgatccctccctgaaaggctccgctttcatccacataatcataggttgtggcggtaccgaaatcaatgacaagcaccggacctccgtatatttcgtatgccccgactgcatccacaatacggtcagctccgatctgctgcggattcggtgtcacaatgcggattcccgttttgatgcccgcctccaccacgatcggtgtgatatggaaatatttgacaagtccgcccctcagggaatgcatcacattcggcaccacggaacagataatggcatccttaatttctgccggatgaatatcgttctgctccagcagattcataagcatcatcccatactcatccgatgtccgtggcatttttgtcgtaatacgaaaacttgcggcgatctcatcgccctgaaacaccccgcaggtaatattcgtatttccaacatctatggttaatatcatttgtcttcctcctcgtccagtgcctctaagccttcgcccagatacagaactttgtaatacatctcaagtgcttccagcaattcccttttttcgttgcgcagctgcttgattttcagcacgcttccgatctcatcatagcagaaatcgccttcttcgcaggaagtgcgaagttccagatttcccgcttcatcaaataccagctccaatactccgccgatatcctcggtgtaaatgacgcacatgatttttaactcgtcacggatggactgtggaagtccgttgaagttttcattcagataaaattttttctggtatgcgttggatacgcacaatactacctcatttgcctctttagacatatccatagattcctctcacggaaacttctccggaagacaccagttttcttgactcccaggtgtctacgatcagttctcccttttttgtaattcccatagcctttccctcaaatggctccttcggatccagtacgcgcacctgccggccacggttcaccagcagctgatcgtactcttcctgtaatgctgacagatcctcagtctgcaaatagatggcatataaccgctcaaattcttccagaaatgcctctatcagatctgcacggtgcacacgttttccgcactccagcagcagggaacctgcatgatcctgcagttcttccgggaagctttcattgtgcacattaattccgattccgatcactatatggttgatatagtcaaactgtgcactcatttccgtaagaataccacagatcttcttaccatttatgacaatatcattcggccatttaatcaaagcctctgctcccgtcacccggtgcattgcatttgccactgccatcgctgtcacgagggtcagcatggatgcatggttcggattgatgtccggtttgagcataagtgtcatataaattcccgttcccggaagggaatcccatgaccgtccgcgacgtccttttcccgcagtctgctggtccgctaccacaaaagttccggacggatgtccttcttctgccagttcttttgctttcgtattcgtggaatcaatcttgtcaaaataatacgtttccgcgcctgcccattcggtctttcggatgcttgccagctccacttcgtccatacggtccggcacagataccagatgatatcccttattctgcaccgcctcaatctcataaccggcctctttcagctggttaattgccttccagacagcggttcgggatacgccaaactgattgcacagctcctgaccggacacatatccgtccgtctcacggagcagtcttaaaatttctgctttcataatcatactttccattcacaaaaatatgtaaacgttttttcttagtcagataacgttgccttcatgatcgccttgatggaatgcatacggttctcagcttcatcgaagacaacggagcgctcactttcaaatacctcatcggtcacttccagctcggataatccaaacttttcataaacctgttttccgatcgtggtctttaaatcatggaatgccggcagacaatgcatgaagatcgcgctgtcctttgcatttttgaatgcatcggcattgacctgatacggtttcaggtcattgatacgctctgcccatacttcttccggttcacccatggatacccatacatctgtataaatgacatcagcatccctggttgcttccgcaacactgtctgtcagtgtgatggttgctcctgtcgtggaggccacgtccacacaataatccactagcttcttgtccggataatattttggattggtgcaggcaacaaaatgcataccaagctttgcacaggtaaccatcagggaattgcccatattgtaacgggcatcccccatgtatacaaacttcacacccttaagttttccaagatgctccttgatggtaagcatatcggcaatcatctgtgtcggatgggattcattggtcagtccgttccacaccggaacccctgcatattttgccagttcttccacgatttcctgtccgtatccacgatattcgattccatcaaacatacgtccaagaacacgggccgtatccggaatactttccttttttccaatctgggaaccgctcggatcaagatatgtcacatgcatacccagatcatgtgcggctacctcgaaagagcatcgggttcttgtacttgtcttctcgaaaatcagtgcaatattttttccaaccagactgtcatgcatgattccctgatgtttcttctctttcagctctgcggacagatccacaagatacaggatctcctccggtgtaaaatccatcatttttaacaaattacgtccctttaatgtcattgctcttcctccttaagtgtacgttgaaaacattttactccatttgccggaattttacaacaatggtatggaaaattgaccgatcaaaaaaggagctctgcctttcgacaaagctcctggatttttaagtttaataaaatacaatcggtcctacaaccgttcccgcatgaccgctggatgccagtttgaagtattttgccccacctgtcggatcactgccgtttaatgcggctctcgctgcctgtctggcgcttgcgctgacaccgctggcaagtcttgcttcaagtctgccggaagatgccggtccaaactgacctctctgatagataactccgtagatagagtttgcaaatccgccgcttctcacacgattaacaacaaccgctccaaccgctgtcatacactgtacgctggttcctccagcctcacactgtacaagtgctgccagaagtgtctcttcatctgcacttgcggcaatcgacgcattctgtgttgtccgggaagatgccgactgaccggacgacgatttcttttcagcagaaacagaagcattcttctttgcttcttccgctgcctttttctcttcggcagccttgattgctgcctgttcttcctcaatggtgactgctttgcctgtatccagtgtgacggtcacataatcgtcactcacataacaggtatctgaaccaactttaacggcaatccatccgcctgtttcttcggcttttgtattcacatccatgcgctcacccgacgcaacggttttcactacctccgcatctgtgtctggcgctttacgaatacgaagaccgtcaatagaaaccttcgcaaccgtatcacagtgcttctttgcataatttaatgcatctgttcctgtcacacaatattcattctttacatatcctgttacattgccggactcaatctttgtccaggtatcgcctgcttctttcacaactgcgcgatcccctttgtacatctttccgacaatttcggaatcagaatctgccttttcgcgaacgtaaagaaaatcatccaccttcgccatcagcttattctgccactcctgttcctcttcggaaacagtttccttttctgtggtttcttctttttttgtatcattcccggatataaccgttccatctgctgttgccgcaaccaaagccgcatttgtcttttcaacagaaatatatctgtccagatagtctgccgactccaattcatattcattcatggcagatgccactccggcaattccgttattgacaaactgtgtgtctgctgcatcctttgctgcaatattcactccattaccggtaactgcagtgaccgcaagtgtgagtgccagtcccgacacgattacactttccatcacctttttgcttgctttcattgatgaacctccgtagtttgtttcatccacatctcaaccgtggattcgtaacattttatgcaataagtattacacttatgttgcgtttttaaacactttatttcatttgttacaagtttgttacgtggctcattgtagcacagaaattcctgtttgtcaaattttagtaaaaaaatgggtggtgctctccacttttactcatattccgtttaaaaaatgggtgtgcgttttcactgcacacccatgccggttttgaaaatgttacatattttatattcctgtgtcaatttatgtattgtttttgataaaaaacattccactatgggaaaatttcctgcaaaacagttgaaattatgcggttttcttcctcatcctcatgtaaatttttattttgcacgttctccggtgatacacttttttcttctttctttttcggcttgtccatgtgtttttttaagtacaattccaggcgtcttctgcaccggtttgcttttttctgttgccgcacaatacaaaataccccaattgttaaaaataaaaaaagtatgatctgcaaacccataatcattaactccatttcattttgccacctgctgatccacatcagtattgtcatatctgctcccatcctttcatattatataaaatcatttcttactgtataaatcttattataatgaaagaacgtcatcaccggaatatcctttcggtcgcaagtttcgacatatgtcgttactgcccatgttgcttgacatttctatatagatcatatagagttgacttaagtaaagaaaagaggaaatatcgaatggctaaatcaaaaaaaattgttatgaccggtggcggaactgccggacatgttactccaaacattgcccttatgccggcacttcaggaagccggttatgaaattacatatatcggttcctacaacggaatggaaaaagaacttatcgaagcacaaaaaatcccttatatcggaatttcttccggaaaacttcgccgttattttgactggaaaaacttttccgatccttttaaagtattaaaaggatatgggcaggcaatctccatcctgcgcaaactcaaaccggacgttgtcttttccaaaggtggatttgtgtctgttccggttgtccttgccgcaaagcactgccatattccggcaattatccacgaatccgatatcacaccgggacttgcaaacaaaatcgcaatccgcggtgcaaaaaaagtatgctgtaatttcccggagaccatgaaataccttccagcggaaaaagcagttcttaccggttcaccgatccgccgggaactgttccacggagatgcggaaaaatcccttcactactgcggttttccagatcacaacaaaccagtactcctgatcgtcggcggaagttcaggttccaaggtcatcaatgaagcggtacggaaagtgcttccggaactgttagagcagttttatatcattcatctttgcggaaaaggaaatctcgatgagaaattaaaaggcgtgattggctatgcgcagtttgaatatgcaagtgcagaactgaccgacatgtttgccctggcagatcttgccatttcccgcgcaggtgcaaattccatctgtgaacttcttgcattgcacaaaccaaacatcctgattccgctttctgctgctgccagccgtggtgatcagattttaaatgcgaaatcttttgctaaacagggattttcttatgtgattgaagaagaaaaactgacggatcagacattacttgatgctgtacgcgaagtatatgccgaccgcgaaaaatacatccataccatgtcagagagcggtcagatggattccatcggaacgatattaaaactgattgaaagtgtttctaaataattcacacgccaaaacaaaaaacatgcatatctgctgtacgtttttccagcgatatgcatgtttttgtatatagagatacagattttttacatcttcatcttatcacagatttctttcatctcatcatcggaaagagataaatgctcccactcaggaactgcctgatctcctgctttacgcggaatcagatgcatatggaaatgaaatacggtctgtcctgctgcttctccgttattctgaagcacattgtaaccgtcacatcccaacacttctttttcgtgtgtaataactttctttgcaagctttgcagcctttgcgagtacttcatcatccatctcaaacatatttgcatagtgctgtttcggcagaatcagcgcatgtccctttgttgcaggacttgcatccagaatcacacggaaatccgcatcttcatagatcgtattggtcggaatatctccgtttgccagtttacaaaaaatacaattgtcgtctttcatttttttgcctcctaaaatacaaatatctgatcgagcatacgaagcgttttaaaatttcctttcgctgtcatctcacccgtcataaacgctctctggaatgtcatccgtccgtcaatgattgactgcagaacatctctgcttaattttgcaaccacgtcaatcttttcttcctgaccgtaatgaatctccaattctccgttttcaattgccacatacaatggctttttgattccttcgataataaaggaatagctggcagcaaaatcctcagtagatacaaaatgactttccagttccttcacaaacggtgtatccatatcatcatccggttttccaagcatatctttgaacatcgatgccaattcctcaatatcctctttctgctgcttcacataagtatcatccgatacatacttcgagagctgctcgctctcctgtggtgtcagattcagctgctgcgtccgcagaacactctgctttactgcctgattactggtcggaagatttttgatcttctgggaaatggtccggtacaggttttccgctttcttttcaatgatcagcgtataatctttattctgcttgaattccaccagatcctctacatatccgcataaccctgcacatggtaatccacccagaatctcccatgcattcatcagagtcagttctccctcgcgctctccataggttgtggacataacaatcggctgcatataggtatggctgattttttccttatcaccatataaccagcaggcatccagaaactgctgcatataaccaccgattcccagccactcaatcgttgtggcaagaataattccgtctgcctctttgaacgtcagcggaagggttgcaatttcattcttatgctcatatatattgaatcgttcaatgtttacccgaagttcccgtaaaacatcttccatcttttttaatacatacagtgtcgggtcatccaaaagtccccggcctccataatacacgttgattttcatcggtatactctccttgctttgatactaattagtatagggattttcccccgataaatcaactgctttacgaggtttccggtataaaataattgcaagaacaaatcccattgcaaggccaccgatgtgtgcccagttgtccacatccacgctggtaattccataatacaggctgatcacaatcataaaaagcagccctttgcccgtaagagattcatatcttcctttgtgtatcatcacaatccacagcaatgccccgataataccgaaaatagcaccggatgcccctgccgatacctcatgctttccccatgcggtcatttgcacataggacagtgtacttcctcccacaccggcgatcagatacagacacaggtatttgatatgtcctatcgctttctccagaatcggaccggcacagatcagtaccagcatattattcaaaatatgttcaaatccaaaatgcataaaagtagctgtaaacagtctccagtattctccctgcttcacatatggcggccagaccgcccccattcttaccataaactccgaattttctgtatttccaaggatttccagaatcacataaacaagaacattcacagcgacaaatcccacggttacaaatggaagtttctttttttgtggcatacttttccctcctgattttttcacatgctatcagtatactcacttccatttggaaagacaaggcagttagcaaaaacgatatcggacatccgcgaaacggatcatgtcattactgtttaattttcttctctctttgtaagccagcggctcatcattcacaaacgtaccatttgtcgaatttaaatcttcaatataatagatctctccatcatgatcaatccgcgcatgcagctgactaatcgtatctgcctgtatttgtatgtccgcatcgggaccgtacccgattcttgtcattttctttgtaacacagatatcctcgtaagattcagctccctgatacaacaacattcccctgactttccctgtcatgctgttcaggcataccgttggccgatattcgggttgtgccactgtttttattacttcctccggatatacaaccgcagacttcgcaagttttctggtatcctgcaggcattccctacttccatgataagattcatatacctgtttttcggtttcttcctcttccagaagacctatttctatcagtagcttttttaattttctgatccactccttctgctcctttttctttccctcctttttctttctgttggctctttttacagtttcatcttttctttttttgtctggatgatcttcatattttctttcaggaactacgggttgattgttttcctctctccaaactttttccattccattttccccggattcctccacggccgcctttttcccctcattttgtctggatcttacaatttcatcccggatatctgtaatagaataaccatccagaagcgtcttctcataaattccatatgcagcctttaccgcctgtgtatctttatgatccacctttgtaagcaaaaattccatcaactgctgaaattctgtctcaatggttccactcccacccggatatacggtaaaaataatttcctggttgctgttggtaataaatattaactcgggatccagcatcaggcaattggtctgaatcagattccattccagaatctccatctcactgcaaatgctcataatcagtttttcaatgaaagaaatatctacttcttttaccctgcaatacatatcaagcgactgtttgccggatatgttataccagtactgtccctccccatccatatatgccttttccactgcaagaagtcccggcaattttctccgcagcatcagcttttcatccagccccgcatggattcccgccgcaattttcataaaacttcccgtaagatttctttcatatattatttcccgattgatcattttttcacctcttttaaaatctgatactgataaaaggaatctaccgcccacatatcttccatctgcttttcttcatgctccccacgtacttcattcaataaatcaattcctgtacacatagctgctgccatcgtccatatcagaaccggtataatcacagccgcctctacggtataacttcctctccatttcatattttctccttttatccctgtaatccccacatgaccagatgtgcccctagcagaaatggtacaaacggaaactcggattttctgtttttatgtccgaataccagcaaaccaagagccgtaattcccgcaatggtaatggcaatcatgacaattcccattatttcacccagtgcataaaaacatcccatacctaaaattaccagaccgtctccatacccaatactttcccttgtactccaggccagtataagcataaatatccccggcaataatcccaaaaaccataccggatttttccaacagccccccagcagtgatatggtcatgcctgatattcccagaagcaaaattgcccagccatgaagttgctgttttctcatatcttcccaggagagtcctgccaatccaaacgtcaatatgcacattctgatcatttcatagttattctgcatgattttacctcacctccgtattcgcaccacatttaccacaggctctttttcctcccgtctcttccaaaaggatcagataaatagttctttttagcccactgcaggcaagatcactatgataacaggttccataatccgtcacatacacctttccggcaacatgattttttgccacgcacccggaacatgcgctgtacttatgttcatttttgtttctcatactgctgatctgtgcataatccgtacttttaatactcaaatccagataatggcactttctgctcctgtgataaacagttccatgttttgtaacatacacataatcactctgctttccatctgtacggtcgccaatccacttatggctcttacttttctgacagataccaacaccctttacctcaaaaaagctaattggaattttaatgtaataattaacctgcaaattaatataatttcctgacagatcggattttgccatcgtaatcgcatgttttccaccgcgaatatatttttccggcaggctgtacgttcccagctcctttctaaaatacgcttccgcagataccagaagccccgtttgcgatgaaaccgcagatgcttcacatgctgtttttctgcttgcataattcaacgcctcctgaacttctgtctgaatctgcaatacccgaaagaaaaataagagcgtaaggaaaaacacggctgctacaggaataatcacggctgcttccagcgtatacgatcccttaaaaaaggaacataaggatgccttttggcaaggatgttctcccaggttatagatatcgtcttgcggattcgaatctattggttcgtttattatcttatgaatacatgcctgcttcggaaaaggttgatatttgagggtaattgttggtttccactgtccaaaagacatccttacatcccctccttcccatgaaaataactatatccggaatgattttgaatccggaatccatttgagaaattttcaaggatggatacaaagccaagaaataccggttggaattcataggtggcagtaagctcagtttcacacaaaacgtggtccatctgaaaattttcgtacccttcctgtgtctgtacatacgcttcctccacatccatggtgcgcattgcaagggtatttcccttatgaaacaaaagcaaaatggcagcatattgtccataatccaatccctgagaacaatctttcgccacagaccagcccgacaaaagttccggaatcatatgtacatttgaagtccagtccgcatcactttttatcattgtaattttcccaccggacaatagtgtccttacatctaacacactttctgcaaatgcccacgctactaagattccgtattttacagcttcgattacggccggatttgcggatactcccgccaacgtgaccgcaagtgccattgcctctgattgtcgctgggaagatgcggttaatgacgccatatttaacggttctctcattgccagcaactccgaaaccacaatttttaaattatccgcgtcatttctttttccgcccagaacatactccagctcatattccaatacgcgatcctgctttttttccacatagtttccaagataattcaccagatactgataaaacaatactttttgataccagtctgttcccacataagaatccatcgtacctttttccagacttctgtgtgaaacagtttcttccataataattgattttccggatacctttgtattttccggcaaaacaagggatagtaccccttctttttttacttctgtcaccgtttctaaaggattctctgttggcgttgccttttccccagaatcctctttctttgttttatccccctgacgcgcttccccctttaactgccgggatgatgaattacctgccccctccgtttcatatttttccggatgcttcagtgcatccattgcatctgcaataccctcatccggatttttatagtccttttttacttcttttactgcttcataatgattgtagacggactttgccatctcatatgcaatattctttttcatataagtacatacagccttctgaaatacgacaccattctgatctgtcagcaatcgatagggatcataccttgcatctgtcatctctgcggtcaacagactcatcccggaaagcaaagttttttgttctttgcttccaagatgatccgatgtaaggccacgcaactgtgcttcccggttattaaaacataatttaccttctgtatcatccacccgtactccaagaattttgtatgtttcccacaaaggactgcaataatcggcaaaaacggattccaaaaccgtatccgtattcatatacaatactttctgaagttcataatgtctcgctgcttctaaaagtgtaaaaagaagctgcgccaccagcatcagtgaaagggctgcaaacacagtaatactcgcctttctcctcactatacctcccctgtgcgttctttaatcgtgttgaaaatatcagaaaccagcgttgtcagttttttcttgaacaacacaacaattcctatcagcaccacaacgatcaacaccatttctacaactcctaccccatcttcttccatcaaaaagtttttaaatcctaacataatttttcctccttatacttgaaatgacagcattgccggaatcataatgatggcaatcacgatgccaagcatcatcatgagtggcaacagcattttcgttcctgcctcttctcccaatttacaggccagtgccttcctttcttccagtgcattctccgattcctgttccaaaagtttacataatcccctgcttccggtctgtaaattctgtaaaagaatccgaatgagtctctgatactctcccaaatccactctttctccaaatttctggtatgcaagacgttcactttccccgtccaggatttcgtgattcgttattatcatttcttcatagatataccgttcttttatttgttttttctgccttttatcagagtattgagcggaaattctattccatgcctgttttaatgacatgcctgctcccagtaaaatcagaagtttacttacaacttccgcataatccagtttcatctgctctttttttatatgatctgcagtatgttttctctccagaacaattcccgccatcaggaaacagacaagcacctcaaaaaacaaaattttccataccagatgctgttttttttctttccattgcagcttcacccctgccgcctgatccggcagcgtcagatacctttccccttcctgcgtactctgctgctctacttcagctgcaatttcatgaatgaccttttcctgttgcgacatcactttcgggtatacttgaaaagaaaacgtatattcctcccggtacttttcacaggtaagtgccacactcgcctgtacaagttctccctggggatctaattgatcctcccggatcgttccatccacgtccactgcattgtattgatccaatgtccagtcggcttttaccaatcctttcacatagcttggcttcatatgcacctgctctgttacatgtgcagcctcttctccctctgggaaaaaggtttcgtctatttccttttctgcccgggaaaaataggattgtgctgtcttttcatcaatacattgtgcaggaacgcttacctgatagtcataatttttcagtttctcccctgcattcagcgtaagttccacttcctgccgcccactgcccggactgccccggataattctgtttttatcgtccatactgcgatcggaaaattccatatatgccccaagcagcaataacagaatacaaacaaccgctgcttctattatttttttccttctcacacttccccctctacatatgtattgtcattattttctctgccagtacaatcgccccaccataagctgcaaggcatactgtcataaacaatgcccctgccacatttccatataaaacattcaggaaatccatggatgtcaccttcagatataacaaaataaacaacggtatcacattcattactttctgttccatctttctggaagcaatctgtacctgaatctccctctctgtttcatggcgcacccgcatgtgccgggatgttgcatcaataattgtcacaaaatttccaccgctgcgttttgcaaatgaaaaaacttcagaaaaacttgcaatatccatatttccacttcgggttgagaaatctcccagcagcagctccaatggttgattgaggctgatggaacaattcatctcctttacctcctgatacatataggaccttttcccatataatgcgagtatttctttttctgcctctttccacgcattttctatagagaaaccagcaagtaaagccgcactgatactccggagagtatccacaaattccttcgcaagctgtaattgcatctgctcttcccctgcttttttctgacgcttcatgaaaaaccagataaaaacaggaaaaaatactatccccagccagctggcataaaataaatacgcaattgccactgtcagcagccccgccaaagtaatgcttttacaaacttccttccggctcagatgatacacacgataatccatcttctatctctcccttctcccgggcaagtcctgccatctccagttttttacgattctttaatatgccacagtgcttccacttccagctgccctcggttccttccagctgataaatcggagaaatctgaatctcgccattttccactccgcatacctctgtgatttccaataccctgcggcttttatccggcaatcttcccaaatgaacaatcaagtctatcccggatgcaatctgttgtctgattgcagcaatcggcagttccattcccatcagtaccatcatttccagacgggagagaatatctctgcttgaatttccatgggcggtggataatccgccatcatgcccggtgttcaatgcctgaagcatatcaaatgcctctgctccacggcactccccaacgagtattctgtccggacgcatacgcaatgccgtgcggatcagatcccggattgttaccggctggacgccctccatatttgcattccgtgtttctaaacgtaccagatttttgattccctgtatttgaagttccgcggaatcctcaatcgttataactctctcatcctccggaatgtactgtgataaagcatttaaaaatgtcgttttcccggagcttgtccctcccgaaatcaacaggttgtattttgcccttaccagcatctttaaaaactctgctgcatcttccggaagtgcccctttttgaataagggtctgcatatccagcggtttctccggaaatttccggattgtgattgtagaaccatccagagaaaccggtgccaggacaatatttacacgggagccatctgcaagtcttgtatctacgattggattcgataaattaaccacccggttatgtcttccaacgatctgctgtatcacatcctgcattttttcttcgctggcaaatgcctgattccatgcatgaacccttcctgccttttcgtaaaaaatatgtttcggtccatttaccatgatctcggaaatttccggatcatccagaagttcctgcaaagcatccagttttctgagtgaattaaatactcttgcttccagcatcagacgttcccgaatggaaatgggttcctcctgcatcagccgggatgcctcttccccaatcagattttcaatttcttcatccgacatctcccgcgaaagatccatgcgttccaatacacgttgccggatacatcctacatactcatccaaccggcatcatcctccggatactgtctccaaattcgttccatttccattgctcgacgagccgctcgcaggacaccacaggggttgccacaggtggaagctgtatctcccgcagattctcggataaccgttcttctccgcgtttttgaatttctgtcaaaaattctttctctctccattgtccaagccctcctctgcttttcatcaggaaaattttctggcagctccccagcaattcaaaaaatcccataaaccgtgaccccagatttaaaacgatggttgtataattcatttcctgcgctaaaatctgaaacaatttctgatacgtcagatttttcacttcacacagacactcggtatttcccagaggatacacaacatctgtcctgtccagatgaccgatgcaggaaaccatcctgctctttgagtattttccgctttctgccatcaccagaagttcttccatcccggacgaataaaattcccccatcagctgcgacaatccactgttttcctgcaaatccagaagcagaactttttcgttttcactcagaatggaggacagcgtgaccgcaaacggaagctgcatttcattttctgccagcgaatatactgcaagaacctgtaatttttgcttcacacccccactggcattttttatttcctccccaatctgttttaaaatctcatcgacgattttattcacttcctgatacttatccacaaacaccacccctttttccacatctttatccacattttcatttccatcaaacagataaatttgtggaatttcacattctatcctattttccccagccaaatcatccgacagaacaattgcatccagggttttccagttctcctgaagtgcctccttctgggaaaacatgtgcagctcaagctgatcccgataatgattcatcaggcagctggtaaaacggtcaccatactcccggtctccaatacagagtcccaatcgagctctcctcatagctcctcctttcttttcaaaacagtgacagccatactgtccgatgcgcatataacattcccagtaaaaccgcaacagaaaaatgcatcagattctgctcctgaacccagccatttcgataagaggagaatttccccgaaaacagttctcttaaaaaaacctgtgctttaaaaaggctgattctaagattgcgcatatacaacatcttgagcacggctattactgctcctgccacaaatgctgccagcacacagtctgtcaatgtttttaaatttgtaaatccaccgataacggaaaaaagtttgatatctccggcgcccaacacacctatgagataaaaaagatataacatgataaccggaatagaaatattcaaaagaacttgaatgattcgcggcattccacccaaaactataccgaatgccatcgataaaaataaacccatgataatcagccggttactgatcctcatgctggtaatatcctgaacgactgccacaattaggattgcatacagtgtcagaaccgatgccccctgcatcgaaatcaatttgcatcacccctttgttgtgaatcgaattataacaatgccaattttatttgtcaagcagttttttacaaattttttgtataacttttccatttttgcttatacttgtaaaagagagacttcagaaagcaggtgatccaatgaaattgtttaagacaacccctcagccccctgacggctatgcaatacttctcgataatctgaaacagacaaccgcagaactgcaaaatacctatgccaatcttgaaaatgtcgttgatccggatttgatcgactattacatttatcaggcaaaagccgtacagatgcgctataaatttcttctgggatgtgtaaaaaaaatagagggaaactattcgcttccctcctgaccgttcacattttacggaaattttatacaaaaaagccccggtgactgtccacatccatataatcttcgtttacggcaccgcgcgcataagtcatccctgcatatacctgctgggtatttttcataaggggtgcactcttgtcctgtttcgccacctctacaaaagaagtatacaatcggtgcatgatatgttccgcttcctgcactccatccagccgattctcgtacatcgcccgtgaaagctcatttttacagaacatatagagtttatacaggttgtgcgagatcggatacgaaaaattgagacttccgatcagttcatccagaacactctgtgcattccggatcgcatccttctgtccatcatgatctcccgtgcagtgtgcctgccgaatatcatccacataggcaaaaaagatatcgtaaatgatgacgatcatctcaccagaattacactggctcagtcgtctcgtaaaatcttttttcagctcattttccatatgctactcctatttctgcagcaaagacagtacctgctgtggaatatcatttgcctgtgataacaccgaaacagcagcctgttccagaatattctgctgtgtatattctgtcatttcagatgccatatcggtatccataagccctgaatatgcggttgtcatatcttcctgtgtctctgcaagactggagcttgcatactcgagacgattggtatatgcaccgattccggagcggacagcacttaattttgcaattgctgcatccatcgtgctgatggctttgtcagcacctccgttgaccgccacatttaccgtatccagatacagactctccgaggaaacttccggaatatgtacatccatattctgatactggttcgcaccgatctggatggtcatcgcaccaacatccgtcacatcaaatgtaagggtatccccattttgtacgtcatcactcagcagaaaatccatggaaaatccacctttatccgtgattttcacacgatttccctcaacatttgtaattactgtacttccaaattcgtttccaagtgtgacctttgcgtccgatccacttgctataagtttgtaactttcgtcatcagcattctgaacaactccctgtgcttttgacagacctgttttttgtgccatctcttttgacataccaatggtcagtgtctcctttgatcccttgttatccgcagtaatattataaactcctgccttatttggatctttttcaaacttgcacccgatctcatctgccacggacatcagctgcttgtatacatcatccgcactcatgcccttttcatactctattcctactccattgatggaaaccgtacccccgtcaaaattcggatcattgatcaggttggacatatccaatgtataagtagcttcctttgccacttcatctactgtaatcgtataatctcccggaagaacctcctcggaaaagtcaattcttgttgcgctccgtgcaaattttgtagtatccttatgtgttccactcacatacacacgtgtatttgccgaaccgtcaagcaacgtcttcttgttgtactctgtatctgtggaaatccggtcaacttcctgtgtcagctgatcaatctcgtcctgaatactctgacggtccgaataagagtttgttccatttgccgcctgaacactcagttcacggatacgctgcagcatattgctgacttcgtttaatgccccgtctgcaattctgagtacggactgtccatcatcagaattcgcttctgcctgattcagaccatcaatctgtgctttcatcttgctggagattgccattcccgccggattatctccagctttattgatcttatatccgctggaaagacgccccatagaaaggctcagtttattttctgtccgaagcagctgccgattggctacaacagcagacatattgcgattaattttcatatttattccttcccgtatacgctacgtttgagcatccctgccctctgatttgacgctccctgtcatttcatctgacatatatatcgtccgaaaatgtcaattctttaataaaaaaaagtataatttgcaattaacgggaaatcgtattataatagcaacattaaacgatatttgcaaaggaggatttatcccatggctaaagtaaccaaggatactatgatcggagaacttcttcagattgatgagaacgtagcacctatgcttttaaacattggtatgcattgtcttggctgcccatcatcccagatggagactattgctgaggcagctatggttcatggaatcgacccggatgatctggtaaatgatatcaacgatttcatcgagcatgatgcaaccgcatagatttcacgtatcaaaaaggagtgctgaatctcagcactcctttttgatttaaattttctaaagagatgcaaacacctgcagtgcctgcggtcccgtaattttatttccatgctccgcgaaatatgctccaactgcaggattataatttttctgctgtgcatattcgcaaataatattgcagactttattaaactcttccggtgtatggtcatctttgtggatcaccagataaaaccggtttttcttctcgttcttaaacaggtcatttcgtccattgtaataatttacaagtacatgtgcgagacgctccacctgatctatcgtcgtaaattcaaacattttcgtcagatctgccggtacttccggtacttcttccggtgcctctgtctgctgtgcattttcactctctggagaggcttttgcttcacgtattttctggaaaagttccaaaatatcatctgcccctttgcgttccacatttccggctgcccccatattcgaaaacagttcctcctcatcaccgccttccgtaaactgtgaaaaacgggtgtcgagttcttccgggtattcaacctttgtaatcagcaaaaccagggattcggaagacaatggaattgcctctaccataagtggattgtcactcacatcaaatccaaactcataatttgcctgctgtatcatatcatggaaaagtccttttgctttctcagaaccatatgccagttcccgcagattaatctgacgatctgcaagatcctgttttgttaatgtgcatcgaatctgattttcatttactttttcaattttcatctctatcacatccttctctggaaatcgctttccgtaaatggtacacttattataatcaaatgccctcccgttgtaaagttaccacggattaaaaaattataaaaaaaatacttgcattgcaaaataaagtgtgttataagtttatgcatgagatgcgtctctgacccaaaggagcgtatgaataacaaaaatttaatattgtctgaccgatacgagctgattcgtccccttggccagggagaatgcggaagtgtctttcttgtcaggcagcaatctttagagcagtaccgtgcaatgaagcgattccccaaaaatacttcggcacaaccgctcttcgcaatatccgaagcacagattctaaagtctgttcagcatcccggaattcccacaatttatgattttgaagaagatgaatcattctactatcttgtggaagaatatattcagggtgactctttagaagaatttttgcttcatcaacagtcaatatcccagaaccagtttttatatttttgtgagcagctttgtgacatttttgcatatctgcatacattacggccttctccgattctttatcaggatcttaagccggaacatattatagtatgtggaacacagcttaaattgattgactttagtgtcgcatcttttgctgccatttctggaaaagacttcaaccatttcggaaacgtggatttttctgctccggaacttatctcaggaaaaccggtaaccctgagatccgatatctacagcattggaaaaatcatggaatatatgatgccatatctggatgcagccaccaaccgatccatttatcccaaaattcaaaaagcaatttcagcagatcccgacctgcgctatgaatcaccgcaggctctgtactctgcattaaaagaagtaattgaaactacgggaagaacgcatctcaggcagacaattgcagtcgttggaagtcacagcggctgtggtgcaacacacatagcaatcgcactggtgacaacacttaactaccttggcatttccgcggtttaccaggaaaaaaactggtcaaacgatctgcgcaagacggttgcccagctgaaacatgtgtgggaaaaaaacggttgtttcttttatcgcaattttacaggatttccaaaatatgacagtggcatcgacatcccagagcctgtcacacaaatcatggtaaatgattacggatgtgatttttctttctcctgccttgcaacggcggatcatattatctatgtgtgtggaggagcattgtggcatcgggacgatgcaaagtccaaagactttcttttacaaaattttggtaaccgcctgcatgttgttgcgaatctgtgcgaccacaattctgccatttattttgccagaacattttcacagccggtctattcttatccgtttaacacggacatctttcgtgcagacaaagaaaagctggattttgttcactggctgcaacaacctgagaaaggacggaatcgcctatttttacgtttcataaaccatttattccggctcctgcaaccataggagtctgcggtacaacagtaaattccggtgtaacacactttagtatttcgctttgcaactttttacacagcagatttctggcccgcaccgcatacctggaagtcaattccagtcatgaaatcgctgcgctttcttcgaaaaaggacccaaccattccttttcgctgcaatggtgtcagctactatccggagattacactccggcagctgcgggaacagttacatctgcaacacaagtataaaattctggatttcggggttctgactccatactcatttccggaatttgtccgctgtgattactgtattgtactgacaaatgtgagtatttggaaggatcggcaactcttgcaatttattgaggaactgaaaaaaacaaatttaggaaaggattataaaacaaatgtccgttttatgagtatgggaaacctcaaaaaagaccgaaaaagagtcgaaacgtcctatggaatccgtgtgattccggttccctttctcgaaaacccgtttcaagtgtcctctcatgattttggattctttgaacaaatatggaaaggaaaacagttatcacattaaatttatctactgacaatcagctggtcattgaattcagaccagaagtatatgaaagtctgatcgttactttttaaaacgatccattaaaaaaataaaataacaaatgggctattattatgggtgtgaaatgagtctcaatgcaactccgtcacgcacaaaataaactgaaaaaagacaaatgggagggcagatccacagacacaactgccctcccgaaaaaattcaaacaacttctatttcttaattttatctgattccatttgaatctgtacaggcacaatgctataatcggaataaatatataatttgccaacagacaaaggaaggacggctcatgaagaaaaaatctcattccattttcgctgtgcttgcactggcacttgtcattgctgcagcgatcgtagtcttcgccctgatccgcaaatacacaccgagtaaggaacacgaagatttaaccacttattatcatctgacaaattccgatgaggttgccattgttttaaataatgaagtaacctcttccaaagccagggtcattgacggtcatatttatattgattatgattttgtccatgacaatttaaattcacgtttttactgggacaataacgagaatattcttctctatgcaacaacacaaaatctgatctcggcacaggcagagcagaccagttatatggttacaaaatcttccgcagattacggtcgtaaaattgttaccataaactctgatactgcatatattgatctggattttgtgaaagaatattctgattttaaatacaaacatgtaaaagatcctcaccggatcattattaccagccagtggggaaaataccagactgccactgccaaaaaaaatgcctccctgcgcgtaagaggaggcatcaaaagcccgattctgaaaaaagtttcttccaaagaggaagtcaccgtgatcgaacagggcgacaactgggacaaagtaatgacagacgacggtattattggatacatgcagaaacgtatgctttcctccgtcaaagaaaaaacaagaaaaagcgatttcactccggatacttttgcacatataaagaaagattacaatatctgtatggcctggcatcaggtcacaaaccagtctgcaaataacgcggtttcctctgtccttgccaataccagaggaatcaatgtactctctcctacctggttttatctgaatgacaacaatggaaacattgccaacctggcaagcctgaattatgtaaattactgtcataaccaggggattgaagtctgggcgcttgtcagcaatctggaaaataaaaatgtcgatacaacagaagtcctgacccatacctctaagagacagaatctggtaaaccagattgtttccatggcgattcaatacaatctggatggaatcaacgtagactttgaaagtatgaacggggagaaagtcggggatgcatttattgaattcatccgggagctttccatcaagtgcaaaaacaacggggttgttctttctgtagacaattacgtcccgatgccgcatacttccttttataaccgaaaagaacaggcaaattttgcagattatgttgtgattatgggatacgatgaacattatgccggaagccccgaagccgggtctgttgcctctttaagctgggtaacccagggtgtaagcgatactttaaaagaggttcctgccgatcaggtaattcttggaatgccattttatacgcgtgtatgggaaatcccatccgagagcagttccgatgacacagcagccggtgccaaaattccctcaaaaatttatggcatgaaagctgcaaacgattttctcgccacacatggtgcaaccaaaacatggcaggatgactgtggacagaactattcggaatttacagataatgacaccacctataaggtatggctggaagactccgcctccgcagaatgccggttgaaactggttgaagaaaagaagcttgccggtgcatccttctggaaactcggatttgaaacgagtgatatctgggataccgttaccaggtatatccactgacttacctgcatatatataggaataaataattccataaagcaggttctatgaaaaagaaatttgaaattcttatggttgcctgtctgtttataagtgctttcttacttgcgcgtgcatcagctgcactgacatcttccagacatgcggcttcctccaaaacctgtatcgttcttgatgccggacatggaggaagcgatcctggaaaagttggctgtaacgatgctctggaaaaagacatcaacctgtctattgtgctaaaactcaaaaccctgtttgaaaacaaaggatataaggttgtactcacgcgaagtgatgataccgttcctgcagatgaaaactcgcgcagtgtaaaagtagaagatctgcgaaaccgcgtaaaactgatcacagataccaatccggttatgaccatcagcatccatcagaacagttttccggatgcctctgtctccggtccacaggtgttttacttcgaacagtctgcggaaagttctgcaattgcctcagtaatgcaggataccctaaacaacagccttaatcctccaaagccaagggtttgtaaatccaacaacgactactacatattaaaaaaaacacccacaccgatcataattgtcgaatgtgggtttctgagcaatgaaacggaagcagctctgctggtcacagatgcctatcaggaaaaactggcacgagccgtttaccttggtgccataacctatctggaaagcggaaaagacgtaccggatactgccacctaatccgtttctttacgaaacgatatactagttacacttgatctcaaactctttatcctgtgcaaactgtgcactgttgtaaagaatcagtatatcggtaggtgaaaacatttccaaaagccggtctccgcttacattcagctggcgaagatccacaacgacaagtttttcataatcttctgccagaaaaggaaggatactgttcgcaaaagaatccttgatcaaaagcagcgtttttccgttctttattcccccggtaatctcaagcactgcctgattcccaccggtaaaaacgctgtactggtctgctgttttcaggaaggaaacatcatacagtgtctttgtcttcttttctcccatattataaacaacacgcagtttatccgccggctcataaatctcaattttgtctgcctgtctggcataatttatttttgcataagttgttccatagaaatctttactgatgcaacggaacttctttttcccctgtgccctctgaagatctccaccaaccgcctttgtgtattgttcataggcataccatgctcccagcgtcgtccagtgatggtctgtccggtaataaatttcttcctctttatgtgcatccagtacgggctccacggaaatcagtacatcctctttttccaatttctgctgcaatgcatcataaaacttctgctccttataatgaggggcaaatgccggaagtttttcccggagtatccacgactttgtcggcaccatcatcacatggacatccgcgttctgttttgcttttccgacaaacttctccagagcctgcagatttttggaaatctgctgcggatcaaactctttttctgtatagtgttccaaaaggtaatggttctttccgatgtaaacattatgaatttcatttttgcccataaacaattccatgtctgtctggaacgaaacccaatgatcccttccgggaaactgatcccgcagatacgattcatattttttctggaatcttccatccagaactttcgttatacttatttccgggcgtgtctgaagttctcttttttcaaccggagaataggttctctgatgcgacagtgcttcttttcctgccaggccgaggagaagcaccataaaaatcacacccggcagccgtttgaatatccgtatcataattatctctatttgtacagtttactgatggcttttacggccttttcattctgctttttatatgcagcaatcactttgtcctcggactgttcctcctgcttgttgctgattgtcccaagcatgataaagcatacatagtttccttttacataaactttggaagcctgaatctttaactggttcatcgggtactgacaggtatcctgtatcagttcctccctgtatttttttaatgccgaccggattttctttttggaagctgcattctttgcttttacaataaccagtgtgtctgcatttgcactgatcatcggcacctccgcaattgcagcactgtaccatttggaagaaattccgtagcgttccttcaattctttctttgatactttttcacttgggatataatcatccccatacgctttctttacagcattgtatactttttgtatggatggggttttcttccctttctgcgtggatgcttctaccgtcaccggtgcttcccatgcattttccggtgcatatattcctgtcacacaggcaagcaccagtatcattgccacaattttctttttcattctccattctccttccagatcctgtatattttcattcttatcgtgaaaccacctgtaatctggtttccgcactatcctactacagatcttttgtttttgtcaaaaggtattttatggaattaataaaaacttccgctgtatgatacaacctcgttgtctgtacctgattggaacggtcttcctccagttctccctgctctttcatttcactttccctccggattccggacatctcaaactgcgacaaagaaagatccggtgtatatgcaacatggatatctgccggttcctgcatggcatcctgcagttcctgcaggtgttcttcgacctgttttgcggtctcttcctcgcttgtcacaattgttccagaaatacggtctgattttacctgaaaagatgccgtgatctttcctgccttttctccatccagaaaaatatccacaagaccctttttcttttttcctcttacgatttttaaagaaaccccggtgacagaatctcctgtctgcatcggaatcacataacattcttcctgcgattgtttcgcaccaatctgaaactgtgcggtcatctggcgcatttcccggatatcaatcgtgcggacatccggatcttctacgatcatcgtatccatcacatgctctgccacatccgcaagcgtctccatggcatctgcaagatccgaaggattctcaagggcttttgaaaactgttcaagtacctgctctttcatctctgcaatctctgtcatggaatctttggaaacatgatcttgctgaaacaaccgctccatcatccggtttggtttgcgcagcatttccgatgctgccatgacatttatcatactgtttggaatatcataccgctccagataggtatatacgtcttccggtgtttctgcaagctgctgatactgcgcaagctgttcctgccgatagcttttttccgcttcctgttccccaacggattcatccatctgccggagtgcctctgccagttgttccggagacatattctgccacttttcttctcccagacgggaaagtttttccggtgaaatgtgttccatcacatcgcgcagacaattctgctggaacgcagccgagatctgctcgtcaattttcggaccttctgctgtgctgtcaactccgtcaaaatcatcgtccacctgataatccagaccactctttttttctgaacgcacagcacgcaaaaggtttcgcatcgtcacgtccgatccctgattcatcagaaatccaagtgctgccccatctcctttttccacctgtgcgatcagacggtaaatgccgatataactgctgcgctcttcctcagaaatctcatgattctgctccagtttccacagatatttgctaaaccgttcctgctcctgtgttccgttctcctgctgaatctcctgtgccgcctgattcagctgctccatagtcatatccagtggattttccccacggcggatcatttccagcgctactgccggtttcatattagaaaacgcacgctgcatctgctcatccagtgcttttacttccataatattttccggtgtaatttcggtattgttatatgccagtatccgcactgcacggcggtttgtttcacttgtatccagctgcagatcctgtaaaatatcgtccacattggaaaatgcttttgttatggaatcccccatgtcactgcgcggagcagtcatcagtgtttcataactttcatttgcctgtgcaaatacgcgctgcatctgcgctccggcatcatgaatctcctgaacggaatcatccgcatccacctgcccgattacatatgccggctgctgtttcagttcggcaaacacatccatggtttctgccataagatccacatttttttcacttggctcaactccggcaccggcaagcaggtctttatagtattctctctcctgggattttaaatcctcgaccagatccgccagcggtgtcagatccatctctacgcctgctttttccatcgccacggatgcctcactggtcattaccagacgtgcttcctccatctgtctgcgtgcagtaatcatggaagcatctgccggacgttttcctaccgcaattgccttcgccatggaatccacgatctggttccagtctatatgatcggtctgcagatcgtccgataatccctgcagatctgtcagatactgcagattttccggtgtaaggggaatctggtttgccaccagccacttgctgttgtccaccgcatgttcgtcatcggaaagacctgcttctgcaataatctcacgaatctgcggcatcagggacccaaaatcaattccgctctgctccggctccacaatattttctgcgctgctgctgtaattggacaaatacagattgcggatggtcggctccatatcatttttcagaagataactcatcgcctgtttcgtgatttccggaatcgatgtagcctgtgccagtgcctccgcactgtcctgcacattttcctccgttgccggcaggtcgtttgccgcaagagagtccatgatctgctgcgtcacaaccggacttccagtgatctcctctaactgttcctttgtgagtgttccacccatggaagacacatccactccggcttttgccagagccgctttaatcttgtctgtcacggtaataatggtatggctgtctgcatcggaaatggaaaatccgtcctcttccatcttctttaaatcttctgtggaagtggtatttgccactacagcgatttcgttgctgcgcgcctgtcccgaagaaatctcctgccctgcaattttttccgctactgtcttttcttcctgcccctgctttgccgggttggaatacgttgccatatcgatatttccagcctcggacaccgcagttttctgctgcacataggcttcctgtccgccaaaagctgcaaccgctccggcatccggcatatttgcctgataagccgcaattgccctgttactgttatcgcgttttgcattccgcgttacatcttcccatatatttttctgctcaacctgcatgtattgcctccgtaccattacattttacgttataacatgtatcggcaggttatcccggaagctaaaggggaagatccatataaaaagatccggagttttcaccagatcttttttcctgatttacgattgtttcattgcctcttcatattctgctaatgtatatttgataagaattttttcttttggcacgccaagttcgaccatgtttcgaatggatgatatgcgctcttcacgccggcctgtttcccgaccttcacgcaatcctgtttcccgatgctcttcccatgctttacacaaatctaccacctctttctcatcctcacatgctatttcaatcccggtaaaaagacagatcgccgccacagtttctgaatccagccgggaaaacttttccggatatttgccaagcagttcctgcacttcctgctcactttcggatgcccggataaactgcagcaactgtccaacttctgtccggaatacggaaaaatcttcgatttcctgtggagccagcagattgatccggtaatccggtatccacggctttaattcttcatctaatgtgccaaacatctcgtgcaggcttcgcggtccatcccatgcttctgctccaagatacaccgtaatcgtaataaccggagtcagggtgtcattcctgtgaaaccctgacaaaaattctggttttgttccccatttcttttcctttttgtgtcgttttccagcctccctgacctgtgccccataatttaacccggcataaaccatgtcctttaccggcattgcataatgaatatcgctttgcagctctgccccaatcaaaaccagatagacattttgatttttcttgattataacacgttttaataaatctctccacttctgaaatgaaatttcttttccatccattccaagcaccgataacaactccgttgtgtcagttgcttcaagtgcttctggcaggatgaccgttctacctccaaacagtaccgcattacacatatctgcaaaacgtctgttatcggcaaaatactcgtttgcctttcggtcttttgcccccatacatcttctcctttgtgatgtcctgctatttaattttctgttacactgggtatatcgggatgaaactcccatgactgattccggtcataaaatatactttccttttatgaccggaacctatgtgataagattaccgtattttcctgctgctgtcaatcttttagcgtcttttattttccaacaaatacaattttgttatcctgccaatagttaatatcgtattccagttcaatatgtttggagtctttcgggacttcaaaataaaccgttccttccgtctgtcttcctgcggataaggttgcgtcaagaccactgtcatccccgatccactgctggtctgccttgctgttgtctgcataacattcccagtccatcattgtcgacacattctgatcggtatccgatgtattttcaaacttaaacttgaactgccagtattcgtaccctttttttggtgtgatgtattcattatcactcttatattttcctgccgaaacaaatgtaattttaaaatcttctgtttctacaacatcgcccacctgaaaaacattgcttttgtcctgagtttctgtatcgtctgttttcttattttcagaagatgtctgcttgtcatccgaaggtgtctggctgatcttctgtgggttcttatccttatcatccccacccccgctgattgcggcaatgacaatgatcacaatgactgctatcacaatccattttccaatccctccctgcttcttccggcagttcggacacaccttcgctttctttgggatttccgatttgcagtatttgcacacttttgtttccttttcttctgccatattccttcctcctcgtttgtaattaactgactctattataccgtatctgtctttcatccattcggttctcaaccataaaaaatagcttccgcatatgattggcatccgtcatatgccaatcataccagaagctgtttttttatggtctgcccacagcagacattttctatttattttcccacaatatgcatgacatccacgcgcaaatagttctcaattgcataccctcccacgaaaaatacaaggctaagcaccagttccagaataatttttgctgccacaggcattctggaaaacggatagattttttgattccatgagccgtaattggtcagcacagccattggaagccagagatagatacccaaagacaaagcttccagcagcatggtcgcagtatttttattgcactctgcgatactgccaatactgtaaattccccaaaaggcatatcccagacaggcagtcacctttttccatgtttttcctgtgcggaaaccgggaagcggcaacaaaatctctgacagtttctgctttcgcttttttgtggcaagtgcccttcgcatttcatctgcggtctgaaaccgctgttttgcatctattgccgttgcttttaaaataattttctgcatattctgcgaaccattgtataagccgtcccccggtaatttcccggtcagcatttcattgcatagtacccctacagcatataggtctgtccttgcatccgactggtgaaatccaaattgttcaggtgctgcatatccaacggttccaagtaccacggtatcttttccctgttcttttttgacttcgcgggcaattccaaaatcaatcagttttacaatgccgtcatctgaaatcatgatattcccggcagtaatgtccctgtggacaatgccaagcgcatgtacctgtcccagtacttccagaatatccgccatataatctttcacacgttcttctgcaaacacgccataatattccagatactgctgcacggaaatccccgaaatatagccggtaatcagaattcccctttcctctcctgctgcaaaatcgtatatgttttccagatgctcattgcgaatggcaatcagcttttcataaacagggattacagaagctgctacatatttctttacaaaaattcttccgttatcacggttttttgcaagaaagatatcctgttccccaagcggacaaatcgtttcatacgtttcatccagatacccatatttcatatcctgattcatatttgacagttcctcataattctatatataatgtctgttgtcattatagcaaaaaggacaaaccatgtgatgaaaaaaaccgaagaattacttaaaacgatccagtcgtgtaaaaattatcaggattttatttccgaaagcagacaggaactgatttccgtccggaaattaggggaagcctttcaggaaatcctgacacagaaaaaactgaaaaaaagtgatgttatccgcaattccggaatcgaccgtggatatgcttatgacatcctttccgataaaaaacagccttcccgcgacaaagtgcttttgttatgcctgggagcctctttctcttttgaggaagtacagacccttttaaagcaaaccggctatcccatgctttacgcacggatagccagggatagtgccatcatatttgcattccggcatcatatgtcgccaatagataccaacgaactgctgtatgaactccaatttgaccttctttcataataagcagttatgttatattttaaactgttctattattttttcaagttcgctgacaatttcccggttgttctctgaaatccgctgcgccgcaatccctgctgaacttttcgccatctttttagattctacgtaattttcggacacgtattccatcctatttctgtgcaaacgcaagcagttcttttcttacatctgccagatattttcgtcctgccacaatccgcgttccatccgccatgtaaatcagacttccaactatagaatccacgtacacgatatttataatatatgatttatgacaacgaacaaattgcggaggcaatcgtttctccatctccccaagggaaactctctccgcatatgccatatttttcatgggagaccttattttatgtctcatcttttatcacatagcctatttcactattttttactatattctaacactatcaaaaccactccacaaaatagtactattacagaacctattagaaatgaccacaacccataattatttataaatccaataaaatgatttgtatcttcatacattaccctgtcaaaggttgaaattgcactcaatactataatttccaaaaaaccaaatattaaaaaaattgttccaagatattttttcattctcatttttctcctaattcatctcattatacagctttatcttttttccgatttattaacaaatccattccatataaaaactcggcagaaattatccccataaaaacagcattccctaattttacattgcaaagatttaaaaataccgcacaaactactccacctgctaatataacaacaccgattttacaatagtttctcttataacctttcaagttttcatcatgaatgacaggttctgtaaaaatattaatcaataacaggcctccaatataattccgaagcattaaaaacatcacacaccaaatcaacattgggatcaacattttaaaataccatgcacacacaaatataaccataacgggaatactcatatttatcatgcattcgatgccatactgaagtacctgaacatcttcatttttctcatcaactacacaggtaacatctgcttcagaacacatgtatattttttttgccaaataatacgaaattttctcactcatatttattttcaccatttttctaatatactgctttcattatatcatatatacataaaaatgctgttcttccctctctttttgttctgtcgtttaaagccaatattttgcagttcacaccaattgcaccaattctattgctttttctatacaaatatactagtatggaattaaatatattttttaaaaaatattatgtcgtcaattaactatctatcaggataccgagtcatacactattaatggcactttatcagatacaatttctgatatcacggatttaattttgagtttttctgcttaaacaaatggttctataaaggatatacaccacagaattgggagaatggagatgattgaaatgcaccgtattccacttaaaattgtgacaagattatccgttatatttacggtcataggtttacttcttgtgatcataggtatttgcacaggaactatgataggattgataatattaggagccgggttagtggaacttgttggaacgataatttttattgctgtgttcagaagatgtcctcattgtggtagttttcttaaaacaggttgtaatcgatattgtccacattgtggtaaatatgtggacgagaatgattatatttacttctaagcaatgatcctgtttttaagttgtacttgaaaagactgcgctgtggtttgtggtgttgtccgggcagatatgaatatccgtacaagacgcgatgtcaagaaatttttagaaggactctctaccggaagttccagccttcttaagaatgtaaccggtggttatcattaccatacaattgaagctgaatccgaagagattttagatgatattcaaaatgaactcgcagaaaaaggttttctggccaaactgcaggattataaacctgtagatttcttgggcgaagaagaatcaaatacaaacgtttaatgcaatcaaggcgtcagtccggtatttccggaactgacgccttttaagcattggaaattgtcaatgccactgttttgtcttacatatacttcttcacaatattctccattactttccacttatgttccatatcagagacaagtttaaactgtgtccttgcccggtccaaattctgccccggtctgtgaattttaaaataaatgtctccctgaatataatccataagaaacctcattccacattcataggtcataagcctagcgcccatcggaagcagctttatctcttcctgtgaaagttttccaccacatccctctataaagccattcgcacatgcttcaaaaagttctaagttgaaccacactttatccagattttgttcatcctctaatgctgtacttgccccaatccgcaccgcatctccaaaatcattcatggctgccccaggcattacagtgtccaggtcaatcacgcatattccttttttggtatccttatccatgaggacattattaatttttgtgtcgttgtgtgtcacacgaaagctgatttttccacttctcaacaaatcctgaaagcagtccacaatttcttccctgtccaatacaaactgaatttcctcccggactaaatccgctctaccgcacacatcctcttccactgcctttttaaatctctcaaatctttctctggtatcatgaaatcccggaattgtctcatgaagtgttttcgccggataatccgctaacatactttgaaatctgccaaatgccagaccgccctcataaagtatttcaggattatctatcaaatcatagcttacggtattttcaatgaatacataagctctccaatactcaccttctgagtccacataatagggtttcccgttttttgccggaatgacatttaatgtctcccgctctggatttccaccgttagctgaaatttttctttttaaaaattcagtgactccaacgatattttccattaattcaaccgggtttttaaaaatactcttgttcatctgctgtaaaatataatgcctttttactccttgttcattttcaaatgtaacacggtaagtattattaatatgtccatttccccatggaatttcttctttatatacaccttcaaaacagaaatttgcagccacttctaattttccgcagagctgttttggataaaaattattctcttccagctttttcaatgcagtcataaccattggtttgtctttcctgtaggtaactccataccacttttctgttgtaagaagaacttttacttctgccttattgttatctaacagtctgctgacaactgacggaagataatattcacatttcagtggattatgttgcagcccctcctgcagaaaatcacgaaatccatactcaacttctgacaaaaatcccttgctaaatccccataaattcatggaaacaatcgtatctcctgccaattccgtataactttttccatcatcttccgtatatgcggcattctctccacgttttacaatcgttgtatgttctattacactgacaagttttccagcaccatcaatctcacagacacctcttgccacacttccattctccgtcaaagtatttttcaactgatatcctaccattgcatactgatacttttcattatcttcatgcacactcagataatcataaatctgcttaaatgcttctcttccataatagtcgtctgcattaatcactgcaaatggtccgtcaatcatatctttacagcttaaaattgcatgcgcagttccccatggctttactcttccggccggaacttcaaatccctccggcagattttccagctcctgaaatgcatatcttactttcataatcttttctatacgattccctatgacattatgaaaatcttccgcattctctctttttattacaaaaataacctcttcaaatcctgcaagataagcatcataaatagaaaaatcaacaataatatgtccatattcatctactggatcaatctgtttcattccaccgtaacggcttcccattccggctgccatgattacaagtacaggtttcttcatattctttatacctcctgattaaacagcgtaccatttaatctcatttgcctctattttcaacgcaaaactgcttccatcgccgcgatagataaccgtattctgtggctcgtaggtattatttacaacacagaatttgccattttttacatatgcatgtacttccacattgaaatttgtactaaaccactgatgtaataagttttcgccatgtgtactccacaaaatgcttcgataaagaattctgctgttctcaaagctatatggcagtccactgatatagaccgaacggccctcaccaaattcatgcacagccatctgaacttctttgtccctctgtaccagaatttctgttccctcatacgcaaacatattcttcttgccctctccgaagtcaacaggctttgttgtatctgcaagaataaagtgatttttgtgttcttcccagttatacttatcgtagtttaaggtaaatccggtttctttttccacaccaattaaatcggcaagctgcagataatgtccctgatactggtgtcctgccggttccccgacaccgataaatccaccgccccggtagacaaattcacgaatggctgcggaaataactgcattctcccagactgccccgccggtgtgtgccgtatccccgtccccgacattgataatgacatcaatatcctttaatatatccttatcctttaaaatatcatcaaaggaaataaatttcacatcaaacggtgcgccgcttaacgcctcgataattcccgcataactgtaattctgtttctgatataaggcatggtgtaccatatggcagccccagctgcggattttgccccagctgtttaaaacagcaaccttcttcacacagtacggtgttgctccttttgcattctcatacagttcacggaattcattgcacacgctctccacatagtccaaaaactccgggaaatctaatgcaagctttaaatatccgccatatccgatacggtcgattggttttcttaagatggcacggcgtgctgtcacccagttttcctttgcttccttgacaggatctccgccctcatggaaggtgtccgggaaaaagtatggaaggaatcttccttctgtatattttacaccttcaatatcagagatcagacgaagtgtacttccgtttccaacgcttcctaccactgcgtcaagaccgatcgttgcaaactcttccatgaatggttctgttccgatccagtgatcccccaaaaacatcattgcctctttgccgcattcatgtgtgatgtcaaccatctcttttgcaagctttgcaacttccctgcgctggaatgcctgaaaatccttatattctttaccaggtacacggtactgattgttataatatccctggtcaatgatatattccgggcggaatttataacccatttctttttcaaactgctctaaaatataagggcttactgacgcggaataaccataccagtccacatatttttcccgctttaactcgtcaaacatcaatgtaaactgatggaaaaacgtcgtatagcggatgacattgacatatggatgctctgcacagaacttgcgcagacgctccatggaatatttatgtgttttcggctgtcttacgtcaaacgtaatctgatgttcgaaatctttccagtcatttgtcaccgcattgtacatatgtaccggatcccagataatatatgccagaaagcttactgtatattcatgaaacggttctgcctcatgaatacagacgcaccctgactcctcattatattcccactgtttggtcgataccacctgacctgtggaacggtcaacaacctcccaccatcgtttaatatcatctcttgtattgacctgcattaactcatccgaaatccccttcatcagaggaatttgcagttcgctttcaacagccgtataaaatccactcataatataacactgctgcacctcatccgggtttgccttcgcccactcattatcttttctcgtggtgtagtaagttgcataaatctttgccccggtctttgtcagctcttccgggaattctgttccgtcacaatcgcggattgcatctgcaccccagcgtttcattaactcaattgtctctggaaccacatccagatttgtaggaattgtgacacggcctgtatttttctcactcatttttcttcctcactctatttcatccatataattactttcttttcttcttttctgcaaaagggcaattataaatccacaatgccattaataaacagataattccaataagcataattcctaaacctgtcatttttcctgtcataccccatccaaaaacagacaggcttattccggcaataaaaagagctgccattaaaattattctgcattttgtgtgctttttccaaaattccattttaatctcccttctcatcaaccctttaaaccaccaacagtcattccctgtgtcagtttattctgaacacatatatataaaattaatgtaggaagcattactattacaagtcctgcatacataattccatactgtgctgctgactgctgtgcctgcatcagatttaataatcctaccggtaacgttttcggtccctttgccgaactcattagtgtcatggaaatgatatattcattccaaaaagaaagaaaattaaacaagattactgtaataatagatggttttgccattgggaaaataattttccacatcgttgtactataacctgctccatcaatatatgccgcctcttcataatcatgtgccaatgttgaaaaataccctgacaacagataaattgtaaacggaagtgctgtcgcagcatatacgattgcaagtatgaccagattatttaacagaaaacttttcccaattactgatttcagccaattgtctccatctcgcagcatcagaaaaattggaacaacaatataattcacgttaataaaaagaccacccataaaagccgcatttaaagatttgcttcctttaaatttaaaacgtgacaaacagtaagctgccggcagtgcaacaattaaaagaattacaagtgccaaagctgtaaccaatacggagtttaacatgtaatctcccatttttgctgtattccaggcatcaataaagttctgaaaataaaaacccttcggcaaagtccacggatttccataaaactctttattttgcttaatggatgccataaacacccatgccaccggaataataatactgactgcaagcattattaaaactaaatagataaaaaatttatacaaccgttccgcagaattcggattatttttctctctcatattttctctccttaaaactccagtggttcacgctctgtaactttatttacaagtgcagacaatgcaaacgagaaaataaatattacaacacctattgccatactgtatccatataatccggcatccttctgtccatacatatagcttagtgacacttcagaagctccgtttgggccacctgaagtcatagcttttacaaaaagaaatgccatattaatagtagaaataataaaaaatgttaatgttgtacgaatattagtccagatcaacggaattgtaatctgaaaaaactgaacgagcctgcctgcaccatctaatccggcactttcatacaggcttttcggcacactcgccatagatgccatgtacatgaccatatagtaaccaatcgcctgccagatcattgcaataataagactgacgatcacaagcgattcacctttccacaaaatcgggttctccattttatgaaacagtccgataatactgtttagcattccgttctccggcttataaattgcagaaaaaatacctgcaattactacaaccgataaaatattgggaatataaaaaataatacggaaaaaattctgtcccctgattttttctcttgacagaatgcctgcaaaaacaagtgcaaatgcaaaggtaactattgtaacaacaacaataagtaaaatcatgttttgcatggaccttataaaattagtatccgatattaatgttttaaaatttttcaggccaacaaatgtttcattcggtgaatatgcacctttttcaaataacgacatccggaatacatttaaggtaggcaatatcataaacacaaaaaataaaattactgctggtgctatgcataccgccaaaaaaccgcttcgtcctctggcttttttcatactttcacgttcctttcaaacaaaccgtactatttaaaattcggcggacaaaaatcctgtccgccgactcatttttaccactatagcattaaggaaaactaaaaactcttatttcaaatttgcccgcatctggtcacttgccgaaataattccatcaatccactcctgctctgtcatatctcctgataccaaagagtttacagggtcaaagaatacagtacgtacttcaatacccggaattgcttcaaatgatgcaaaattgcccatggctgcctttgctccattatcatagatagaataaaacatgacattatcaccttctaatttatctgcaattcctaataccggctgaatagctcctgcttttgcaaaaatttcacatgctttatcactgtataaatatgagataaataattttgctgcatcctgatgttctgcaccagaaggaatccatgcctgctcaaaccatgtataactataactgtctcctcccgcttttaccgccggaagagctgtcataccccacttaaatccatctgcacgaggagcatctgccatttcaccgacaatccaggttccatttggcatgaaaattgccttattatcaagtactaactgctggttctgtgtaaaatcctgatcatttgcctgtgccggtgtaataggatttgtgtactcagctaactttgcaacaatatcaaaacatgtctgtgcttctggtgtttcccagataccttcttcataatttgtagccttatcaaagaattcagatccgcctgcggcatacattaatgcatagaaaaatgcatcaaaatatcctgttgtcggatatgtaaataaataaattccctcttcttttgctttatctccaagttcccacatttcatcccaggttgttggaacatcccatcctttttcttctaaaagacctgcattataaaacagaccacatggggaataaaacattggtgcaagatatgtctttccatcaccataaggattcgtcaatgatgtatctgtaaatcctcctgcaatcttctctgaaacaagtttatcttctcccggaactttcatagataagacatctgtaatgtcagtaatcatatttcccttaataaactgttccgttaacgcagcttcacgtcccgtggccagatgaataacatccgggtattcgcctccctgcatggatggtcctattacatcctccaattttttatctgttgtaagttctacctgaattccggtttcttctgtaaatgcatctgtcacttcctgccacatttgcgaaccataacctgtctcaatcgcagctacactgattgttgttccagcataagctgcatatggatcatctgatgttgtctgtccagtttcttctgtcttgctgttatctgacgcagaattctccgttcctgaatctgtaccgcaccctgcaaataaagatgctaccattaccatactcatcattgtacataaaatttttttcttcatagtaacctcccatttttgttattttttactataagttcttatgtttccttccctacatttgttattatatagtacgccatctctttttcctatccatatattgctctatattttataattattgctttattttaaaaatcttgttattttgttttttttattgtatactaagtacaacatcgttccattttgaccaggaaatcattgcaattataacatgaaaggactgtattttccatgagcaaccgcaaatttaatctggataatgaggtacagccggaaatccatttccgcctgctttccatatcagcatccaaatttgaaaatgactggacttcgtttccccacagccatcattttacggaaatcttctttattaaagacggcaccggacgcatgctgattgaaaatgaatctcttccggtctcctcaaacagccttgtcgtgatcggtgcacaggtaacacacacagagttttccgatccggaaaatccactggattattatgtgctcggggtggaaggattaaaactgaatactgacaaagaaccggaatacattcatgtcccggcttttgcaaactcgccttttatccgccagtgttttgaaaatatcctgcgggaaatgcataacaaacaggaccgctacgcagagatctgccagcattatctggatattttaattttatatttctgccggaaagaccatgtatcctatgaagtggtggatgcgcagaacagcagccgcgaatgccacaaggtaaaacgctttatcgagcacaattaccagagcatgatctctctggattcgcttgccgaaaactgcagtctctcaaaatattacctttcacaccgttttgcagagctgtacgggaaatctcccatcgcttacctgaacgaagttcggctggcgtctgcgcgtgacctgctgctcacaaccaatcacagcatcgaagagattgccggatgtatcgggttttcctctaccagctatttttcgcagtccttccagaaaaaatttcatgaatcgccacagcagttccgcaaatcccaccgtgtcaggacatgaccatgtttcattttttacataaaaaaataattttctaaaaatttccccgaaagaatatcatatctttcggggaaaggaaatggatttttattcttccgtttctggaatcctggtggtacatatatcagattattcagggaaactatgcctatcagccggattggaaagagaatttacaatgttttggactaaccatcgtgcatattctgatcacatgtattatctatggcattatgggtatgttttgttgtgcaacatccttttatttccgcaaccgaaaaacggtatattttgtaagtatatttttctggctgattgaaattttaaaacctggctccctgcttcgcaccaactctattgcttttttatgcaaatatgctattgtaaaattaaatatatattctggaaaatattatgttgccaattaactatttacacgaaaggaaaaccatgattaagagtaaaaaaatactataggaattgtgaaagatacaatttgtaaaatcgccctgaaaaaagcaaatacaaactgtcttagccttatgtatgaacccccaaaaccaaagtgcacttggtatcaacctcaagatcaacattatttacattcaaataagaaaggtggaaattgattataaaaaaatattaagtataattttagttatggtattcatgattactttcaataacaacgtatatgctgcagaattagataatatgcaacataacgaccaagcatatgtgttaaattcattttcaggaaataacttggaaagtatttcagtgagattttaaaatcacagaaaatcaaattgaatttgaacagtttggaagaaattttttattttctatacacaaattaaatatggatacaagtgacgggaaaaacattccagatgccaatttttatacaggtatatcttctactatcttaaaaacaaatattttatttgcctacaaatacaattttattgtcctgccagaaattaatatcgtattccagttcaatatgcttggagcgccgcattctcctttgaggaaacacaaacgctcttaaaacaaaccggatatccccacggaataagagatttgcgatgttcactatgcttccattcctttaaataatccattatttttctatacatcactgcacctccatgaaatgtttacttttggcatatcaattattcatgtaaaaatcaacgtatttttcatttgtttttacactaaattgcatgaattatttctaaaattatacattatttaacacgaatcccgtgttacgatcaaataattaaaaaagaagccggacatccacttccatgaatctccggcttccaccatttctgtttaaaatttaaatactgctactccgtaaggcggcagcttatatccgatcgaataatcccgtccatcacaaggcttcttttctgccttgtaagacagcggacgcttcgtatcttctgtgtcggttccaccaaactgcggatctgcactgtttaataccagcttataggtatgtctgcccggcacacctacccgataatcgtcacgctctactggtgtgaaactgatcacaaaaagcaggttattctttccatccttactctttcgcacaaagctgaaaatactgcgttcatagtcgttggcattcatccactcaaatcctgcccaggtcgtatcctgctcgtacaggcatggattcttacggtacaaatgaagcaatgcctttacccaatcctgcatatgtttgtgtttcggatcatccagcaggaaccagtccagttcgcgcttctcgctccactcacgctcctgcgcgaattcctgtcccataaacagaagttttttgccggaatgtcccatcatgaatgcatagccagccataaggtttttaaacttatccccttcgagtccgggcatcttgttgagcatggaacatttcaggtgtacgacctcatcatgggataataccagaatgtacttctcactctcattgtaactcatggcaaaggtcatcttgttgtgattgtcctttcggaaatacgggtcaagcttcatatagtcaaggaaatcatgcatccagcccatgttccacttgtagctgaaattaagtccgtcatcctctaccgtacccgtcactttcggccatgccgttgattcctctgcaatcatcacagaacccggatttcttccgagaatcagcgtattgatgtgcttgaaaaactcaatggcttccagatttttatttccaccataaatattcggaacccactgtccatcttccttcccgtaatccagatacagcatggatgcaactgcatccacacgaagtccgtctacgtgataattctcaatccacatcagcgcacttccgatcaggaagttcttgacctcattctttccgtaatcaaagattttggttccccagtccggatgctctcctttgcgcgggtctgcgtattcataggttgcagtaccatcaaactctgccaatccatgtgcatcttttgggaaatgtgccggcacccagtcaaggatcacgccaatcttgttcttatggcattcgttgaccagatgtgcaaaatcctccggtgttccataacgggaagtcggtgcataataccccgttacctgatatccccaggaaccatcgtatggatactcggaaattcccatcagctcgatatgggtatatcccatgtctttcacataaggaatcaaggtctttgccagatcccgataagaataaaatccatcatcctcacgccccggatgccgcatccaggaacccggatgtacctcataaattgccatcggctgctcatatacttcctctttggaaagtttttttctggcattcatccattccgtatcggaccagagaaaattggaaatatccgtgacaatggaagcggtctccggacgcagctgtgcatagtttgcataaggatctgctttgtacagctttcttccatcctgcgcgataatcaggaacttatacatgcagcccagctggacacccggtacgaacagttcgtatacccccatcgtctccggtgtcacacgcttcatctcgtgagaggtctcattccatccattaaattccccaatcacatatacacgatctgcatgtggtgcccagacatcaaagcatacaccctcttctccttcaattgtcattttgtgagcacccattttgcgataaatatcataatgtgttgcctgtccaaacaggtaacaatccatctctgtaaaattactcataaataccctccctgtcttctcttatctatcttactcgaaatccttttccgttagtacaattctgtcatcatccgtataacggctggcggtcagaatactgatagctttctttaaccctccatgtgcctcccgatgaattgcttcatccacaatgtctttcacctctgtcagggttgtagcctgatccagtctctgaatattgctgatccggttatacaatgccagaaccgccatatcatcaattttgtatccaagttccctggaataagaacgtgcaaacgtgaccagctcatcatttgtaaaaatcggaactgagatctgttcactgaattttttggcaaatgtttcattctgcgcaaataatctcttgatgcccttggatgtgtcttcgagtataacgaaaagaccactctcatctgcgtccagcaatccggataactccgacacggtctttttctccatatctcctgcctgttcaataatcaggcatcctcctgccaccttatccagcagcccgccgacatttttctggttcaatgcttccgcatggatctttccaatctttccatccaaaaccccggtctcctgctgcaggactttgatcatgctggtggcaagtgttgtttttccacttccctgtccgcctttaattacgagattccccctcgatgcagtttccttatttttcagatgggacgaagcaactgtcaacgctttgcagagctgatcctccatgcccttcaccggcataaaataagaaaaaatcgctttctgttcatcggtcagttctacaagcggaagattctgtttttcctcttttcccagatccaccggtgtgtctacctgtggaatatgtactgtttttcctttccaggaagagcgatctgtttttcttcttacaaaagcaaactcttcttccctctcctgtgcaagtgttggtttctgtggcagatcctcgatcggaacctcctcaaaatcctttttctttgttgtatctgattctgtctttgtttccatttcttctacaccacgattctcatttaagtttttgtcatcttctgtcacatcggatgtctcttctgccggtttctgtgcggcagcttcagtcttctttttctgctgggaacgtaccatttcttctaaagatactccctctggccaaagttcttcggcatctgtatccctggcaggctgttcctcttttttgttctcttcctcttcttcctttcgttcttccggctcattcgttgccggcggtgtttccctttccggcgtctgtggcggtgtttccgtcgtttcctccacaatatccgccttctctgccagtaccgcatccagttttggcaatactcctgtcaggcggtccataatatcgcctgcctcctgcagtgcacgcgctttggcggattcgagtttccgctttctggcatcttccagtgcagcttccgcagccttgcgcattttctcccactcactcagcacttcctcaattgtcatctggcctgtgatctgatgctcaatcatgtttttctcatttgtcatcatgctcatctgaccatcggagtcttctcccaacaattctttgaaatttgtcttgagtgaaccatcaatctcctcatctgtctcaatgtgccgtgtattctgttccggctgtgcctcaggcttttcttcctccatctgcattttcagataaggaacatcttccaccatacggttgatattgtccagcgtatccgtgacggtttctttttcggttgcatccatgatctgctgcataccctttgcaatttccgcctgaagattgacggtattaaaccgttctgtgtttacttctacttttggaattgcgaccggatcatgcacggtctccccggcacgcgccatctcctccacatcaatgtgtgtcaaacctgctctgtcatcttttgcctgacaaaacgaccgatacttttcttcctgtgttttcgtcaatggctgatacagcattttcagttccaatgcacgctctacatatggcccgtctccaaaccagagaaccagctcatcacatgcatcaatacacttctcactcatccctgctttgtgatacagataagcaagctcatatgcccactcttccgtatattcctgctccttgagttcttcaagaatcggtatcagttcttcataagaagccccctgtgccttctgtatatcatagcgaagtacatatttaagggtgtcatgaggcgcaatctccacaaactcatcataataatcctgtgccgcctgaaaatctttcatcttgaccgccacttccgcaagacggtaaataatcattcttccgatcggcgagcggtcatatgccatcagcaaaacttcccggctctcctcataacgctgtactttttcgtacacttccccagcttttaccagaccatttacatttttaaccttattccaattgatagtatctgcaatatctgctgcctcatcgtatttctcttccgcatagcgggatttcatctgatcaagcttcagattatattcgtatttgtccaattgttatctccttaaaatatccccaaacaggtctatctgtctattttcaagtataccataggcggcaattagtgtcaaaaaataatccgaaaaaaagagctgcacacaaacgcgtacagcccttgaaattactggtttttctttgtttcgtctttctttccggaatcttttaaagttctctttttcttttgtttttccccgtaatatatgatcgcaccggttgcctcatctacaccggctgcctccacatatgcctccgttacggttgtaaggtttttcttccgtatgctgtggtttaccagtctgcggataatatagtaaatcatcgcaaacaccggaaccccaagcagcattcccagaaatccaaacagtccgcctccgatcagaatcgaaaacattacccagaacgcggataatccggtggaatcacctaaaatcttcggtccgataatatttccatccacctgctgcagaacgataataaatatcagcagatacaacgcatgcagcggactctggatcacaaccagaagaagtgacggaatcgcaccgataaacggtccaaacaccggaatgacattggttactccaatgataaccgcaaccagtatcgtatccggaatatgcaggatcagacatccaaaataacagattactccgatgatggcagaatctataatctttccaatgatgaaaccaccaaatacttcatctgccttgtggaaaacttcgataataatatttccctgttttggcttaaagatcgcatacacaatctttttgccctgtcccaccaggctttctttaatggataagacataaacaacaacaataattccaatgatgaagtttaatatggatttgaccatcgtgattacgccggaagtaatctgcagcagatattgctgcatctgtggaagcagatcgttcgttgcccagttttccacataatccgtcagctttgtcagcatatcactgatggtatctgtcactccataggctccgagttttccgcttttcaccatacggatcagactttctacattgccgggcagtgcttccaccagcccggtaacacttgataccaccgaaggaacaattgcggcgatcaaaagcaccaggatcaccagaaggaacaggattgccccggcaatggacaatccacgtgccactttagccgctgatttttctgatttcattttctttttcagaaacggcagccagtgccgctcctgaaatttcataaccgggttaagcagataagcaagtcccagtccgataataatcggctgcaatgcacctgtaatcagatgccaggtatctgcaacccccttgtaccggagcaccaggaagaaaaatacggtacaacaggcaaaggtgagaaataccatcaatccgattttaatcagaaggaccgtctgacgcatgccatcctcactctgtttgatctgttccatctgtttttgtttttccacgtctgtcatacaagatctcctatccgcggtaataattgatcaggcagcctttgagaataatatctttctcatccggtgtcagttctcccatacgcagggtaaatggctttaaagcaccatcctttaccacatatgcctcaaattctgtttttccgtctgcgatcgcctcacggatctttggaacaaacaggtaatccagattgtggaacggaagctctccctgatcaataacaaacgggatcataccccagttaatcaggttggaacggtatctcttggtcgcatattcatttgcaatgtttgcccatccgccaagtaccttctggcaggaagccgcctgctcacgcgcagaaccgtctcccggttttactgcaaaaatcgtacttccaaaaccaacgtttgagcgattgacatcggagaacgttgcacggatggtatccataaccggatgaatctccggaagtgcatcccccggacaggtatctgcttcgacagccttctgtgccttctgtacttccttggcacgtccaacatattccggatcctttctggaaagtgcaaactctgccagtcccagtgggttggaacggaaagaggatgtctcaccagaaggaatcagctcgtccgttgtggtcaccggatcgtgaatctcggaaacaactttcagcacaagattctccggaagcgggctcatagccggccagtccttaatatttggtccaaactggatctctacgtccggatctgccacacccttgctgtcaaatacacggttttcataaatggtcttatcaaagaagtatttcggcttgctgtagtttacatcaatatcggtagctgcggtaaggaatcccttatttgcagcggttgcagcgatagaacgcgcatccatcagtgctacggaagcaacctgtccgttctgtaccttagatccctcacgattcgggaagttacgtgtagaatgacggatagaaaatgcattgttcgcaggcgtatctccggcaccaaagcatggtccgcagaatgcagtcttgacaatagcacctgtctctaacagattggcaacggcaccgttcttaaccagttccatataaatcggagtagacgccgggtatacactcaacgtaaactcgtccgctccaatggaagaaccctttaagatatctgctgcgtcgcagatattttcaaatccaccaccggcacatccggcaatgataccctgatctacatacagtcttccgttctttactttgctctttaagtcaagatctacttttccatcaaaacttacctgtgcacgcttctcgcagtcatcaagaatatccatcaggtttgcatttaattcctcgatcgtgtatgtattgcttggatggaacggcatcgcgatcattggcttaatctcgcttaaatcaagttcgataaaactgtcatagtatgcagtttctcccggattcagttcctcgaaatctccggttcttccgtgaatctcatagaattccttcacctggtcatcggttctccagatggaagacagacaggttgtttctgttgtcataacatcgacaccgatacggtaatcaacactcagattggacacgcccggtccgacaaactccatcactttattctttacaaatccgttggcaaatacttcaccgataatggcaagtgcgatatcctgcggaccgacacctttctgcggggtacctgtcaggtaaatgccgacaactcccggcatatcaatatcgtaagtcttattcaaaagctgctttacaagctccggaccaccttctccaattgccatggttcccagtgctccgtaacgggtatgggagtctgatccaaggatcatctttccgccgcctgcaagcatttctcttgcgaactggtgaataactgcctgatgaggaggaacatagattccaccgtatttctttgcacatgtcagtccaaacatatggtcatcttcgttgatggttccaccgactgcacacagactgttgtgacagttggtgagtacataaggaatcgggaacttctcaagacctgatgctctggcggtctgaatgatgccgacaaatgtaatatcatgggaagtcagcttatcaaatttgatctgcagtttttccatgttgccggatgtattgtggttctttaaaattccgtatgcaatggtttgtttctttgcatcttccggtgtaacagtctttcctgtctttgcctggacagcagatgccgcttccggtgaattaatgacaacatccctgccgttgaccaggtatgcgccgttctcatataacttcatagtttcctccttgttttcgaaatcatggttaatggtaattatataataaaatgtatttttatgcaacgactgcaaacgtaatggatgccgcaaacagatcgccatctaccaggattgcaaactcaccgcccatcagctgtgtaagattctttgcaatggacagtccaagaccgcttccctctgtcgtgcgggattcctctcccctcacaaaacgctccgtcaggtctttcctcgccgctccctgttccggcagcggatttttcgaaatatttttgatacggaaaaccgcattgttctcctctacttccagatctacataaacccgggtattttcgagtgcatattttgccgcattggtatacagattttcaattgcacggtagagctgccgtccgtctgcccggatcatcaccgaattgtgcggcagtttcgtcacaatggtcagcccccgtgcctcaaaacgttcattgaactcaccacccgtctggtacagcagttctaccagatcgatggtctgcatatccagctggatatttccggaactgatctttgatgcttcgaccagatcctccgtcagctgtttcagccgctgggatttttcatccagaacccggatataattacgtgcattttcgttttccaggttttcacgtttgagcagatccacataattgacaatggaagtaagcggtgttttgatatcatgggaaacattcgtgatcaggtctgccttcatccgttcattccggatccgctcctgaatggcttcgctcagccctgcacggatattattcacagaagctgcaatgcctctttcctgtccgtgaaactgttccacatccagtgtcgtatccagtgcccctgccgcaattttttcaattgcatgctggatctcatatctttcgcgcgccttacgcgtacacagtctgggattctgtccggagataaacacccgtctcaggaagcttcctgcctgatagatcagactgtatgtcagaagggtattgtttttgacccgccggacaatgctcaaataaaacagcaggaatacaccatcgaccagatacccgactgttccgaccgctaccatcagtccggacagttcaaactggatgtcatggagatttctccccaaaaagagcacaagataaatgaatgccacaaaaagtgccatctggatatccgtataaattttatcaatccaggtcaggtaaatggttgcatcctcctctgaccggcgccctgcaacacctgtcagataggcaaggaatacaaagcttccgaccatgccgatcaccataaacaggctgagaatacccagccctccgatatgtctgcgcagattgtatccgatcccatagattccgcaaagcatcataatcagaaacatctgatgcatgacaatggctgcgcccttttttccgctggagaattctttcatagacagctacgcccccgcttcgattttatagccgacaccccagaccactttcagataccgcggttctttcggattgatttcgattttttcccggatatgccggatgtggacagcaactgtattgtcagcgccaattgcttcttcattccagatttcctcataaatctgactgatggaaaatacttttcctttatttttcatgagaagcagaagaatgttgtattcgatcggagtcagtttgacctcttccccatctaccgtaactttttttaattcatcgttaataaccagaccgccggcttcataaacggcatcaccggaaggagtgctcgaaagtgtggtataacgccgcagctgtgacttcacacgggcaaccagttccagcggattaaacggcttggtcacataatcgtccgcccccacgttcagccccagaatcttatccgcatcttctgtcttggcagacaggatgataatgggaatgctgcttgttttacgtgcctggaatgtcgcacggattccatccagtttcggcatcatcacgtcgatcaccatcagatcaattttctttgtgcgaagcatatccagagcctgttccccatcatatgcttttactacctggtatccttcctgaatcaggtaaatctcaattgcgtctacaatttccttgtcatcatcacacaccagaatcgtcatgcggatgtcctcctatcaggttcttgatcttgttctgaaagccggcgaatttttctttttcttctgctgcttcctgttcttcctgttcatctttccacttaaaataatcagcatccagattcacacgcagttgttcttccagctgctttaactcttcatcgtcatcttctaccgtaaccggtgccggaatctccggcttcggcgacagcttctttggtttttccaccggcttttccactggcttttctactggttcttccgcaaggtcttctaccggttcttccggtacggaaagtcccagcttatccagatattcctggttaatcttaatatcggtctgccggtttgcgtaaattgctttttcttcccgcttctcctgctcgtactccggtcttccttccatcttttccttctcaatctcgcggttccgttcctcgatgatctttaagtacttttcggtatcaaccagatcctgcagctgtcctttgagttcggatttgttggttcttaattcctgttcttctttttccatctgttctttaatttcctgatagatagcaccgacctttttgtccgcctcctgcataatatcctgcatacggtttaacgtttcatccatatacatgacagatgccgcataaatgtcctctgccttacggcttgcatcccagatgatctgatctccctttttatggaaatcgcgctctgccttgtcacggcttcgtatggtcagttcgtattcatccataatctgataaatacaggtatttagttctgccagcagatcaatcacctgctgcttatctatgataactttactcggctctttcggatacggctcactcttcgacagcaaaacgtgaagactgcgcagtaccttttccgtattgtcctgtgctcccatgtgtcctgattccttccataatagataattccgtactttctattataatcaatccccctataatacgcaatattttagattcttaggtttttctaaatttaattacacaaaactttattttttacagacacaaggttataataattttttgaaaatgaacctgtttaataaaggatatatactatgaatatcgtcaaaacttacggaaattatattaaaaaatatgccggcacccacccggcagtttcccgcaaaatgattgacatcggattacatctcgaacagttccggactgaacattttgcagaaaaaacaatgccgaaagcatatcagaagctgaatacgctcggcgtaaaaaatacgcttcatgcgctggaatacccggaatccacggtctggtgcaatctgtttgcacccgtggaaattttccagtgcttcggactcagtgcgctttccatggaatgtctttcctcgtttctctcaggatttacgtgcgaagactattttatcgaccgcgcagaaagccgtggaattgcctccacgctctgttcctatcacaaagattttatcggtgccgtagactccggaattattttacctgccagactcggtgtgactacttccatgatctgtgatggcaatattaacacattccgctatgtcagccggcacacggatcttgacacttatgtgatcgatgtgccggacagctgttctccggaagccgtggaatatgtgaccatgcagctgaaagaactgattcagaaactggaagcactgaccggaaaacgtctgtccatggatgacctgtcggaaacacttgcccgcgaaaaccagtcgaaagcttattacaaagagtttttaaaactgcaggcagagcgctattatccatcgacactgactctgcagatgtacatgctttttgccacccacttaaacatcggaacactggaaacccttgatctgttccgcagttttgccgaggatatcaaacaatatccgaaatatgacggcacccggattgtgtgggtacatctgcttcctttttatcaggaaacactcaaacactattttaacctgaacagagattaccagatccagtgtaccgaaatgaacctggattacatggacgaactggataccacccacccactggaagcacttgccactaaaatgctaaacaatctctataacggtccatacgaaaaaaaagcaaatatggtcgtaaaactggcaaaagaaatgcatgccgatggcgtcattaacttctgccactggggctgtaagcaatctgccggcggagtattccagcttcgcgaaacactcaaggccgcggatattccactgctcgttctggatggcgatgccatggaccgccggaacagccatgacggacagatcaaaacccgtctggaagcttttctagaaattctggataaagagaggaattcatcatgttaggttatgtatgtaaatatacccccatggaattatttgaagccatggacacggaaatcacacgtctggaaccatccgttacggattttaaccatgcggataccctgatgcacgccaacatctgttcctataccaaggccgtgctggaagatgtgatggaacatgactatgagggtgtcattctgactacctgctgcgacagcatccggcgtctgtatgacacattaaaaagccagttcccggataaatttttctttttgctggatattccccgcaaatttaatgattttgcagtgacgctctatgagcgccagctaaaacaaatgctcaccgagtacgaggctttctccggaaaaacactggatctgaaacgttttgtttccatgatgcagaacaaagcggctctgaaaaaacaggaaaacacccgcatgtctgccagcgcagtgtccgaaaaagaaaacggacaaaaactcaatattggtatcatgggtgcccgatgcaacaatgaaatccgtcagctgcttgtcgaccgcggtgccaatctgctgtttgatttaacatgcaccggacttgcacgtgatttttccattacagaggatcaggccctgcattcttatgctgccgcgctgctaaaccagattccatgcatgcgcatgttaaaagcagcgaaccgtgaacattttcttgacggttttaccgaccgcctggatggaattatatatcataccgtcaaattctgtgactcttattcttacgagtatgcggatttccgccagcggctggatctgccgattctgctggtagaaaccgattccaccagacaatgtgccggacaggtccgaacccgtgtggaagcctttatggaagaattgaaagtgaaaaaaggattgtccctgaccggggaaaaacaaatgataaaaagaaagggtgatactgtgtatacattaggaattgacagcggctctacctctacaaacgccgtaatcttagacgaaaacagacagatcaaagcattttcagttgtccgcaccggagccaaatcttcccagagtgcagatgccgcactggcagacgttctgaaaaaggccggacttgaccgggaagatatttccctgattgtatccacgggttatggtcgtgtcagcattccatttgcggacaaaaatgtaaccgaaatcagctgccacggaaaaggtgcgcatcttctcttcccggacgttcacacgatcctcgatatcggcggtcaggatagcaaagccatccggctgaatgacaatggagaagttgccgattttgtcatgaatgataaatgtgccgccggaaccggccgctttctggaaatgatggcgcgctccctggaaatcagtatcgatgaacttggcccggtatccctgcagtccaaagaaaatattgaaatcagcagcatgtgcagtgtttttgctgaatcggaagttatctccctgatcgcacagaacaaagagattgctgatattgcacatggaattcacaaggcaattgccgggaaagcaatgtccctcctgaaacgtgtcggtctgaatccgggatatatgatgactggcggtgttgccaagaatccgggtgtcgtcgccgtgctggaggagcagcttggagaaaaactacatatctatgaggaaccagagattgtcggtgcactgggtgcggcattgtatgggcttgaggagatcctataaaccagaaaataattttacaacaacaatcgtgatacgatttattttccaatcgtatcgcaattgttgtttttctgttactgttataaatcatttgacttctgtccgaaaatacgatattctgtttttactggatttataaaattatataccacaattacttatgcgatacatcgccattgtaccgcaatcaccactcatggagagcatttcgctcataaatttccattagaaccacaatttcatagaactggtcataacagctctgttttttatactttctatattgtaacagcagatgcttatgatatatactaaaggaaaggtaggacgctacatggggaacactgacattttgacaacttcgttgccagatgccgacacagaaaacacaacagaacacagcacgattttcgacgatgtattccgaaccatcgcgcaaaaaatgccgcagcttctcattccgctgatcaatgaagttttccacacttcttacagcgaggaggaacagtttgaacaattgcgaaacgaacattacgaaaagtacggaaccgtgatcacggactccattatccggattggtggacatatataccatctggaatgccagtcctctaaggacagggcaatggttatccggatgttcgagtacgacatttcgattgcacttgaacatgcttctttgggggaacatgcaatttgggagattgcgtttcctcaatcgtgcgtgctttacatccgcaatcaccgttcgcttccggattatcacgaggcaatcgtaacgtttgcagatggtcagaaagtacgttaccgcgttccggttttgcaggcgaaaagatacacggtggatcggatttttgaaaaacggctgctgattctgcttccgtatcatatcttacgatatgagcattttttgaaacataatggaacaaattcgaaaaaagtgaagcatctgctggacgatttccgggagatcaaccgaaggttagaggacgcgtccgaaaaagaacaaaagtcgcatttttatatggatatgattgttttaattgagaaaatcgcggattatattatcccagaggataatgctatcaggaaaggattgggtgagattatgggtggtaagattttgaagttacggtccgaggaattactggaacagggtgaagccagaggagaggccagaggcagaatcgatgcaattcaaaatatgattgatcttggtttaaccaaagaacaaattttaaaaaaatattctccagaagaatatgaaaaagcattaaattctatgccagtgaaagcataaacacaccaaaagggattccaaggaatcccttttgatgtgtaatgaccatatttacttttactgtaacagagaaagtacaccctggttagactgattagcctgtgcgagcatagactgtccagcctgtgcaagaatgttgttcttgctgtagtttaccatctcttttgccatatctgtatcacggatacgagactcagcagaagatgtattctccgaaatattatccaggttgtcgatggtgtgctctaatctgttctgtacagcaccaagtgcagatctctgggaagataccttagagatagcatcggaaatagcatcgattgcgtaggttgctgcagaaccgttcttgtcagttacatttaatcccttgattccaaggtttgcagaattcatagtatcgatatcgacagtaattttatttgtcatatccgcatctgcacctacatgaaggctgaagcttaatgtgttggcaacttttgcctgaccaacattaatcttaaatgtaccattaccagcattaaatgctaaacctgtaccatcaccattcgttacagatgcatgtccttctgtatcaccgatctggtttgcagcaagcaattcctttcctgcaagttcatatgctttctgctttgtgataacggaagtatcattatcatcaacaccatctgctccggctgcatcttttgcatccgtcaaaacagtcatggttgttgttccatcgcttactttaacaccaccctttacatagtcttttaaattagcgactgtaactgctgtatttgcggtatctgtattagcattatttttgaaagtactatctgttgtgagttcttttgatgtatcaaatgcttctgctgccgttgctccacctgctgtctttacatataatttatttccatctttatcacatacatcgccattagcctttactttaaaggttttatccccaatagtaaatgttttatctgggtcaccatttgctggtgcttcaatcagagccttagcatcagcttctttagaaccaattgtataattctttccaccaatacttacagtatcgccatcatttaactctttcatcgtaaatgtagcagttccatcgccattatcagtcaaggttccctttaatcctgcatcatgtgcattcatattgaccgtcttctcaccgtcatcaccctttaacagataaatctcattgaatttggttgtctcagcaacacggtcgatctctgtatttaactggtcgatctcatcctgaatagccttacggtctgtatccttggaatttgtaccgttagaagcctgaactgcaagctcattcatacgctgtaacatgctgtgaacttctgtcaaagcaccttcagcggtctgtacagaagatacaccgtcctgtgcattggaagaagccttgtccaatccacggatctgctttctcatcttctcggaaatggtaagtcctgctgcatcatctgctgcacggttgatcttgtaaccggaagataacttctcggttgacttcgcctgtgctccggatgtgataccaagcattctgtttgcgtttgctgcctgcatgttgtgttgtactaccatactcataatagaatcctccttgaactcccactttgtggggtattatgttttttcctctggaaatccttttcctaaggtgttcttattgcgtcactttgcagtaacgcgtcacaagcatcttttgatgctttgcgaccttgtatcaaataagcggagcgtcccgggtgtgccccacctattaccaaaatttaaaacagatcaggagttaaatttatctttcaaactctctgcatctttctttgcctctgccttcatccgctcgttccacaggattctcttaatttcctgctgtgcctctctggaaatgcccggctctgcataataggtttctctccttcgtgccggattttcttccgtggtacttctggcaatattaagttctctcggggcatcaatgagcagccttgcgtgattacccgaaccaccgacatagaccacacggatgtcatccccgatatttacgtattgtccctgtttcaatgaaagtttcagcattttttacctccatgcacgcaaaacctttttgctacgttttgtatcttttatatcgtccgttcgctacggtttgttaacctctgttttttataattgctacaatttgttactttttatctaatttttccattctcattcctttaaaaatcgtttatttttgtgcatattttacatttctatgcaacattctgtaactatatgactattttttcgcttcctacaataaattaacttctgttttatcaatagctactatctgtaacatttcatgatatgtgaaaaaatagactaattttaagaaaaggtggtattttattatgagtgaaaaaaaacttcctcagaaattgaaagaactgagaaaggtaaataattacacgcaggattatgtagccgcggtacttggtattgtccgccagacatacagccattatgaaactggcagacggacaccggatgccgaagcattatataaactggcgggtctatacaacatttcgattgacgatctcatgcatctgactgttgatattgaccgcgaagtttcttacgatgcaccggttccttcccagtccagcgaagacttatctgagtttcttgaattttttaatgatcccgcgaataaaaaaaagtacatgtttcatacgaatctggaaaaagaattgcttttttattttaacaagatatccgaagaggataagaaagaaattattgaatttacaaaaattaaggcccgtaagcctttataacagaaaaattgcttctccagatactgtttttcatggtatctaaagaagcaatttttaatactatggaaattacaatttcactacatgcactttattccggcttccgcaagcctcttgtattcttttccacaagcttgcgtgtcaccatcatctgatgtccacagccagtgcatttcaggcggaaatccgcgcccacgcgcaaaatctcccattcatggctgccacacggatgtggcttttttaatttcacaatatctcccacttcatactggtactgattcatagctagtctccttctttttctccccttatagacaattgtaaaacccgcgacagcaggagtcggagtatgttttgcaattgtctattattttttctggctaacatttgatctgtgaaaagacatttccaagtccatcctggataagaagatccgcacgcgcatccattggagttgcactcttattaatcaaaacaagcttatttcccctgtaataatcaatcaggccggctgccggatatacggcaagcgaagttcctcccacaatcagcatatccgcatggctgatataaaataccgcatcctgcagtgttttctggttcagcccttcttcataaagaactacgtcaggcttcaccggaccaccacagacaggacagaccggaactccttccgagtggagaatatcttccgcgctgacaaactgtccacagcgttcgcagtaattgcgcaatacgcttccgtgcaattccatgacgtttttacttccggctttctgatgcagaccatcgatattctgggtcacgacccctttcagttttcctgctttttccagctctgccaatttgaaatgggtgatatttggctgtgcatccagacagagcattttgttccggtaaaaccgatagaactcttccggattctgccggtaaaaactatggcttaaaatagtctccggcggatacttatactgttgattatacaaaccgtccacactacggaaatccgggattccgctctcggtcgatacccctgctccaccaaaaaatacaatgttgcccgattcctccacccattgcaaaaactgttccgttgcttccattttttctcctttctccgcgaacagggaaaaaagaggctgtcaccgtgtgacaacccctgtctgatttcctgtgctatatggcaaattgatatttttaatattcttataataaggatgccagttgctactatacagcctctgtattataaaatacatctttcttcatctctccggcaatttgctttgcattctccagatcatccaatatctggtatgccggtgttgttgcgtcttttaaattctcctggagttctgccagtctctgtgcatcctgttgctgctgctcacactgctgctggatatggttcgcctgatttgccatctcatccatggaacttgaaatctcttcgctgacagctgccagggaactgatggaatcggaaatctttcccacactcttctggttcgcatcattgatctcccatgcagaattaatcttctcgctcatatccccaagtgcctccaccgcggtgtttgcactgtctgaactctttgcggatgcttctttgatacgctccacgaattcactcatgttggctgtcatgttctgggtctgttctgcaagtttacggatctcttccgcaactactgcaaatccttttccggcttctcctgcacgggctgcctcgatggatgcattcagtgccagcagattggtctggctggaaatggaattgatcccttcaatgacttcattcatattactgataatgtcaaaaagcttctccatattctgtttcatggtacttgattcactgatcgtcttatcggacagatcgcggatagccgtcagctcctgctgtccctcttcgatgtttttgtaaatcgctgcagattcttccgatgcagacaatatcgtattggtcagttcctcatgctggttggaaacctcccctgccacacgcgaactttctgacgcagactgcgtagcgtcctcggatgcctgtgcgatctgctgtgaaacagattccatcttggaattataatcttttaaggcatccacaacctctgcgatctgtaacgatgcggatgcattctttgccaagatctgaccgaactggctgcgtccgttcaccagacgggtatacagctgctgtatctccggatcttttgaataatctacatttttcaattccagaacggcttgcagaccggctctgtctgtcttttttccaaatgccatattatatacttcctctctgttgtaacatacaaatctctgtatcttctgccttttattctgaactaaaatatgtttaaagtcaacatatttctatcataatctggatattttttgacaattttgctgctacacacaggttgccatgcgaacaataacacgattcttacaactttaggttttccacacaagaaatacacttgccacaattccggcagtggttgcaaaaagggctcccggaagtgtatatcttgtcttttttacttttaccgacataaaataaaccgacatggtataaaaaatggtctctgtgctactgagcataaccgatgccgcacgtcccagcatcgaatctgcaccatgtgttttgtagatatccagtaaaagtcccgttgctgcagaggaagaaaacatttttaccacagcaaccgggatcagctcggtcggaaatcctgtcgccgccattaatttcccaagccacccggaaataaaatccaaaaaacccgaagcccgcaaaatacctactgctgccatcagtccgattagtgtcggcataatctccactgctgtgcggattccgctttttgccccttccaggaaatcctcatatacatgctgccggtgcatcaggccatttcccacaatgagcaataccagaatcggaatgactgcctcggataagtacagaatcaaattcatttttccaccctcccaaatgcctgccggagcttgatgaaaatgacagctgccaacgtggaaatactagtggcaatgatggccggtcctacaattgcagccggacttacggctccatactggctgcgatatgcaatgatattcactggtatcagctgcagggaagaaatattaatgataagaaaatcacacatcgcgtctgtcgcctgatttgacattttctgcagccgctttaactctttcatggcagaaattcctgccggggttgccgcccagcccagccccagaaaattggacaccatattcgttgccatatatctgcctgctgcggaattttccggaactgacggaaacaaaaaacgaagtatcggtcccattgcagatgccgcacggtttaccatcccccctttttccgcaatcttcataagtcctacccagaatgccatggcacctgtcattgtcaggcaaaggcttaccgcttcctttgccgaagcaagtgcctggtcggtcactgctccaagatttccagtcattgcagcatacaccaccccgacaagaatcattccaccccataaatagttcatccgcgcctcctgtttgcgttcttaaatcattgtatgggctttgcttttttcatattccttttgcaattaccggataaacccaaaagggaaggcatagcccaggctttccctgcataaattttcttaagttttcttacaggagtttctggtatgaaacatcttttgaaaaaacaccggatgctttccgtgggtatttttctggctgcggtgctctccattatttatgcagccatcctctcccctgccggaaaaagtaccggttctttttctgaattttgtaccacgctttttcgcgaagagatgaaatccaacaccatgaatctgcactttacgctaaaagatccaaaagctgccggcattgactcttatgagatcacgcttggcagtctgtccggtgacagccctcataaccaggccagacagctcaaaaaactttcggaagaactcaaaaaatattctcaccgctctctcaaaggaaaagaccgcttgacctgccggctgctttccgattatatttcacgccagcagaaccttgctgcctatccctattacgatgaacctctgaccccttccggtggtgtcacctcacagctgcctgtgcttctggcagagtatactttccgcaataccagagatattaaagattatctcggactgttgtcgcagatggatacttattttttaggaattttagattatgaacaaaagaaagccgatgcaggacttttcatgtccgatgaagcctgcttaaaagtcattgaagggtgtgaagttttcaccgaacatcccgatgacaattttctgatcgatacgttttccaaccggttaaatgccatggatgggcttacggatacccaaaagaatgcttatttgaagcaacattccaaagttctgagtgatcatgtcattccggcttacagccagatgatcaaaggacttaccatgctgctgggacggggacataacaactgggggctttgtaacttcccgaaaggaaaagcctattacgaggcggtcgtgtctgcagatacgggctgtgatgacagcgtggaagatctgttttcccagattgccaaagcccggcgggaagatctcacgttctgtcagaatcttttggaaaataatccgaaacttgcttcccagtctccgaaacccgatgctgccttgaaagaggaaaatgccatgctttcccggctgcaaaaagaaatccttacggacttcccggcaccaccacagacagacgtggaaatctgccacgttgatccggcactcagtgagtacttggctcccgccttttatattacggctccgattgatgatatttcacacaaccggatctacataaacgatgctaaaaatgatacggatatctattactttacaacgcttgcgcatgaaggatatcccggtcatctgtaccagaccatctgcacctcctcctatggtgctccggaagtcctctccctcctcaactatccgggttacaccgaaggctgggcaacctacacggaaatgcaggctttttattatgccggacttgatccggatctcgcctccctgttacagcacaaccaggccgcaacactcagcctctatgccactgcggatatcggaattcattattttggatgggaaaaagaaaaaatcgccgcattctggagcgaatacggcgtagatgatactgccacggtaaaaagaatcacggatctaatcctcgaagaaccgggaaactacctgaaatattatgttggctatctgaaattccgccagatgcgtgaacagtttgcgctcgaaaacaaaagcttttcggtgtctgcatttcacgaagcaatccttcgcaccggtccttcgcctttttccgttctcgaagaaaccgtgcgggatcagttaaaataaagtctattgatcttttttattttaacagtgcctgatagatatcgcgcttgctgaccccacggtcttttgcgacacgtttcatggcttccttgcggtcaatcccctgggactcgtaatgcgccatgtgttcctccagggaaagtgcttcccatccggcctgttcctcctttttcatctcttcgcgggaacggccggcaatgatgaggacatattccccacgcggctcattgacttcataataggataaactgtccgtaagcgtcatctgcagcttttcttcatgccgcttggtcagttcccggcagatggtaagcctgcggtctccgccgagggtatccgaaagttcctgcaaagtgcgcacaaggtggtgtggtgcttcatagataataatcgtacgtgtctcggtctttaattcttcaagcaccgcctgatgctcctttttatccttgggaagaaacgcctcaaacacaaaccggcgcgttggaagtcccgacatggtcagtgcggtgatacaggcggctgcgcccggcagcgaagtgaccggaatgccttcttcatagcagatgcgcacaatatcctccccgggatcggaaatgcccggtgtccctgcatctgtaattaatgcaatgtttttaccctcacgcatttttgcgacaagctggtaagccttatcgattttgttgtattcgtgatagctggtcatcggtgtcttaatctcgaaatgattgagcagccggatggagtttctcgtatcctctgctgcgatcagatccacttctttgagtgtccgcagtacacggtatgtaatatcctcaagattgccgatcggggtggcacacagatagagtgtgccggttttatgttgttccatgggagttccttcctcttcgtttctatacaggcgattgcgaaacaggtacgaacgttatgcgctgcaccggtttcgcaattgcctgtatttaagaataggatgaaactatcatacttgtcaagtcgcaaaattataactgactccgcaccgcacaccgggcaatgcaatcattaatcgaatactccctttcccattgaaaaatatcgtgctaaaatatatctggaagtaagaaaagaggatttcatttatgcacgataacacacagcatttatataacaatttggacttacgaaagctgctgatcccgattattgtggaacaactgctttcttctttaatggggaccgccgataccatgatggtcagcaatgtcggctctgccgcaatttctgccgtttccctggtggattccatcaatattcttgtcattcaggcactgtctgccttatctgccgggggcgcgatcctgtgctcccagtatctcggcagccagaacaaaaaaaatgccaaccgttctgctcggcaggttttgtttgtcatggtcattctgtctgtaactttatccgttttctgtctgatattccgtgatccgctgcttcatgtaatctttgggaaagtagaacgcgatgtcatgaccaattcccggatttatttcttctttactctgttatcgtttccgtttatcggactgtacgatgccggtgcttcgattatgcgctcccagaacaacagccgcaatccgatgatcatctcggttatttccaattttatgaacattggcggaaatgcgattttgatctttgtacttggcatgggcgtcgaaggtgcggcgatatccactctggtatcacgtattttctgtgccatcgtcgttatctggcagctgcgcaatgacaatgccccgatctgtatccgcaattatttttccatccgccccgactggtatctgattaaaaaaatcctgtttatcggaattccgtccggtattgaaaacagtatgttccagttcggtaaacttgccatccagtctacggtttccacacttggaaccgtagcgattgccgcgcaggcaatgaccaatattctggaaaacttaaacggtattgctgccataggtatcggaatcggactgatgaccgtggtcggtcagtgtctgggtgcaggacgcaaagatgaggccatctattatattaagaaattgtcctggctgtcagaggcagtcatcatcgcaagctgcctgctcgtttttgcactgaccaaaccgattaccatgcttgccggaatggaacctgccagcgcaaaactgtgctttttcatgataagcttcatcacgatcgtaaagccagtttcctgggtactttccttcatcccaccctatggcatgcgcgctgcaggtgacgtaaaattctccatgattacctcctgctgcaccatgtggctgtgccgggtaagcctgtgcatttatctctgccgggtatggggattcggcccgattgctgtctggatcggtatgttttccgactggacgctgcgcgcgatcattttctccatccgtttccactcccggaaatggttaaatcatcgcgtcattgaaaaatgatgatattccagtttgtaactttcttttgcgaaaaaatcagcgggcatattgtacccgctgatttctgtttcttatctgcaatctatattcatcaattcacgcaactgaaaagcatttcatttacatttttgctgcatcatcttattttgaaaacaccgcatcatttttggaaagaagatatacacaatactgattcatgctgattccttctctctgggaatgttctgccaacgatctgtgcagacttcgtggaattctcaatttgaattgcccggaataatcctccagactatctggctcatgaatctctacaccatcttctaatgcagcttcaagccatgccttttttgcatctaacgcattttctactgcactttctacagtttctccacaggtaatgcaccctggcagatccggataagaaaccacaaatccaccctcatccttatcttctataatttccatacgataggacattgccatataatcattcagcgtcttcatcattctccgcctcgctttctacaatctgccttaccatttctacatatacttttttgatcggttcatgttttggtattgtgataagtgttctggcagattttccggattttcttttttatgtaacgaatttttttgcacaagctcaatagtcacccgatattcattatttttagacaataagccataaaaacagccatgcatattccccaaaatacacatggctgatttactctacaaaagcaaatttcacagataccgtcccgtaacactatcttcatttcccacaatctcctccggggtcccagttgcaatcacccggccgccgtcatctccgccgcccggccccatatcaatgatataatcggcgttgcggatcacatcgagatcgtgctcaatgaccagcaccgtcgccccattgtcaaccagcgcatcaaacacgctaagcagcgtctgcacatccagcggatgcagcccgatcgtcggctcatcaaacacaaacaccgaatccgactgtccttttcccatttcgctggcaagtttcagccgctgtgcctctccgccggaaaggctcggcgtttcctcgcccagcgtcagatagcccagtcccagatttttgagcacttccagccgctgatgcacaacctttaaatccgcggttgcctgcaaagcggtatttacatccatctccatcaattccggcagggaatagcggtttccctgtttgttttcatagccgatctcccatgcctcttttgcataccgggaaccattgcactctggacacggcacatccacatccggcagaaactgcacatcgaggctgatctgtccggttccgtcacagaccggacactttaattttccggtattataggaaaaatcgcccgccttgtatttccggtttttcgcatccgcggtccgggcaaaaatcttccggagttcgtcgtgtacattcgcataggttgcgaccgtggaacggacattgattccaatcggtgacgcatcgatcagcttcacatgggcgatgccctctgccgaaagatctttcacatgtttcggcagatgctctccgttcagctgcgcctgcagccccggaatcaggctttcgagaaccatcgtggtctttccggaaccggataccccggtcaccacggtaagcctgcccttagggatgtccacctccagcggctttaccgtatggatgcggtcggtggaaagatgcagttttccaagggcaaacagttcctccggtgcgatcggctgacggatgcgcagatcctttgtctttgcgagaaatggtccgatcatggagtttttattggcaatgatctgtggaatactgccctctgcgatcacatatccaccgcccgctccggcttccggtcccatctcaatcacccagtccgcctccgataaaatctgcgtatcgtgatcgaccaaaagcactgagtttccatctttgatcagatcatgcatcacggcattcagtcccacgatatttgacgggtgcagaccgatcgacggctcatcgagcacatacaacacgcctgtcgtgcggttccgcaccgcccgcgcaagctgcatgcgctgccgttccccggttgaaagcgttgccgccgcccggtcgagggaaagataagaaagtcccagatccatgagcctttttgcaacggtcttaaacgactcgcagatggattccgccatcggacgcatctctttcggcagggattccggcacatgcgccacccattcgaccagctctttcagcgtcattttgcaggcttccgccagtccgatcccacaaagtttcggtgcacgggctgcctccgacagcctgcttccgccgcactccgggcagacttcctccttcaaaaacttctccacccgcttcatgcccttttcgtcttttacttttgccagagcattttctacggtgtataccgcattgtaataggtaaaatccagctctcctgcctgattggatttctttgctttgtaaaaaatatgctttttctccgccggaccgtgatagacgatatccttttcttcatcggtcagatctttaaacggaatgtcggtgcgcacgcccatctcccggcagacgtcagtcattaacgaccacatcaggctgttccacggtgcaaccgcaccctcatcaatactgatcgaatcgtccggtacaagcgaatccagatccaccgtccggacacttcccgtaccgccacacttcgggcaggctccctgtgaattaaaggcaagctgctccgcactcggcgcatggacacgttcgccgcactccggacagatgatctcctgttctgccgcaactttcagtgtcggcggaacataatgcccgttcgggcaccggtgcgacgcgagccgcgaatacatcagccgcaggctgtttaacagttcggttcccgttccaaacgtgctgcggatgcccggaatgcccggacgctgatgcagggccagcgccgccgggacatacagcacttcgtcgacctgtgcttttgccgctctggtcatgcgccttctggtgtaagtcgaaagcgactccagataccgtctggagccttctgcatacaacacgccaagtgctaacgacgattttccggagccggatacgcctgcaatcccgacaatctgatgcagagggacatttacatttacgttttttaagttgtggacacacgcgccccttacttctatgtattttggttcgttgtgactgttttccataaagacattacccgtgtatgaattatcttgcatattatcttgcgtactttcttcctcaattatacagaaaaacatgcgaaattccaatagtgttccagacagaaaaaagccggtgcctcccagacgatgcaccggtttttccgtttactatataaaatactcccttgtaccggctgttaagtcagccacccttttaagctttcagatccagtgaacggatctcctgccgaacctttaaaatcatggacgggctgacagaaagctcatcatatcccatactaagaaatgtctcagtcagtgtcgtgtctgcgccaagctcgccacagataccaacccagcagccacccttatgaccgttgtccacaatcatcttaagcatcttaaggattgccggatgatgggaatcataaatgttgtcaagctttggattctgccggtcgatcgccagtgtatactgtgtcagatcattcgttccgacagagaagaaatccacttcctgtgccagttcttcggacatcatgacggctgccggagtctcgatcataataccaagctcgacatccttgtacggaatcttttcctcatccagttcttttttcacttcctcgatgatcttctttatggtctgtacctctgtgacagaaatgatcatcgggaacatgatggcgatggttccgtaatagcttgcccgatacagtgcacgaagctgtgtcttgaatacctcgcggcggtccaggcagatacggatcgcacggtaacccattgccggattatcttctttgtcgagtccgaaataatccacctgcttatccgcaccgatatcgagtgtacggatgatgactttctttcctgccattgcctcggctaccttgcggtatgctgcaaactgttcttcctcggttggataatccctgctctccagataaaggaattcgcttcggaacagtccgatgccgccggcatcatttgccagtaccgatgccacatccccaacgcttccgatatttgcatacaggttgatctttgttccgtcctttgtgatattctccttgcccttgagttcctgcagcagacgctttttctcttcatcctctgctttcttcttctggtaagcttccataacggagaccggtggatcaatgatgatcctgccctcgtatccatctacgatacccatttttccatcgacatcttccggaaaatcgacaccgatcagtgccgggatattcatggtacgggccagaatcgcggtatgggaattggtagagccgtgacgggtgacgaaggaaagcaccttcgatttatcaagctgtacagtctcacttggtgccagatcatcggcaagtaaaatcaccggttcatcggcattcagaccatttcctccgttgccctgcaggatggacactacgcggtttgacacatccctgacatcggctgcacgctcacgcatataatcatcatccattgccgcaaacatctcggaaaatgtatctccggtcgttgccacggcatattcggcattcacctgctggccttcaatcatatttgtgatggattcgatataatcaaggtcatccagcatcatctgatgtacttcaaagattgccgcattgacttcaccgacttcttttaatgccttatcataaagtcctgcaagctgttgttttgcggtatctttggcatcttcaaaccgttttacctcttttgcggtatctgtgattttctcccgttttacctgattttctgatttacggtatatggcaaggcggccgatggccaccccgctgtatacgcttttaccctgaattgtcatagcgtcacctcatccttttgctgattcattctccgtaaacggttgccggaactgtttcttacagtttctcctctaagaatttgccaagtgctgcgattgcttcctcttcctgatctccatccgtctttaatatgatttcctgtccgcattttacaccaagtcccataacaccgagaattctctttgcgtctacttccttgccatccttgctgatggttactttacatggatatgcagcggctgcttttaccagctcgcctgccggtcttgcgtggattccctgctcgtctttgatggtataagtaaattctttcatgatcattctccttttcaaattttgtttctttatcaatgttactgtttacagatttttctgtccgtttattcagcatcctttttgatcagtccgagcaatacggctgtaatgaaagagccgactgcccatgcaaggatgtataaaagcggatgtcctacggttgcaaatacgaagattccaccgtgaggagccatcagtgtgcacttaaacagtgcggataaaaatcctgcaactccggcaccaattaaggtacatggaattacgtgaagcggatctgctgctgcaaacgggatcgcaccctcgctgatgaaggaagcacccattacaaagttggataccttggatccacgttcttcctttgtaaatttcttcgggaagaactggcaggcaagcgcgattccgatcggaggaaccataccaccgaccatgatcgctgccatggcaatgtaacatgcctgaacagccgggtcgcctggctgtgcacctttttcaatcatctggcttgcagttgccagtacgccggtaccaaatacataagcggctttgttgattggaccacccatgtcgatcgccatcattgctccaaggatcagtccgagtacggtgatgtatcccgcatcagagattgcggtcagtccgttgctcagtccggtattgatcagtccgatcaatgggttaaagatgaagcacattaaaatactgataattaaaattccaagcaacggataaatcagagtcggcttgattccgtctaaggaagccggcagttttgaaaacgcttttttcaggaacagtacaataaatccggcaaggaatccggctaaaattccgccaaggaaaccggaaacggtgttaccgccgttagcaccctggaatgcaaagtctgcgataaatttctggaaaccggttgtggaatccgcccagttgtaaccggtgactaatgcgttaccactcgaggctaacaaaccgcccgtaaaaccaactgcaagtcccggccggtctgcgatcgagtatgcaatgtaacctgcaagcaccggaaccatcagtcccattgccagtcctccggcatacttgaagaatgccgataacggcgtacaggaaccgaatgccgatccaccggttgcaccatagcccatcagggtatcgatcagaaatgcaatcgctgtcatgatgccgccgccgataacgaacggaagcatgtgggataccccactcatcaggtgtgtgtaaatcatgtgtgcggtagaaccaccctctgctttttcttcttttctgctgccctctgccgcatggtagacaggtgcatccccggccacggcacggtttaacagctgctctgccttgttgatgccgtctgcaaccttgcacccaatgactttctttccatcgaagcggtccatcggaactttggtgtcagctgcaacgatgattgcggtcgctcctgcgatctcttcatcggtaagcacatgcttggctccgccggaacctctggtctctaccttaatcgtgattcccatctcagctgcatgcttctctaagctttccgctgccatataagtatgtgcgattccggtcgggcatccggttacggcaagtaccttgtattttgccccagtttcgtcttctttttcatcctcatcttttgcgctttccgcatcatcgatgacttttaagaattcgtctacggtctttgcatttttcagtccgttggtaaaattctcatccatcagaagtacggaaagtttgctgagcacctccagatgtacattatcctcggtgtttggagctgcaatcagaaacagtaaattgacaggtgctccatctaacgcgtcaaactctacgccatcctttactaccatagctgccagtcccggtgctttcacagcatctgacttgcagtgtgggatcgcaattccctctccaattccggttgttccttcttcttctcttgcaaaaacccccttgcggtaagtttccacatcgcggatttttccgctttttgccatgagatcaaccattttgtttaaaacatcctgttttccggctgcagaaccattcagttcaatgctctcggctgcaagcaaatctctgattctcatagtataccctccttaaaataattttttatttgcatccatcaatgcaagtacttccttttttgttgccagttcttcggaaaaagcactggcacttccggtacatacaccatagcggaacgcatctgcatagctgccaccatttaaatatccatatataaaaccagccaccatggaatctccggcgcctaccgaattgacgagctttcctttcggtgcctcagcccggaactcctgaccgtcttccgtcacaaggacggccccgtcacctgccatggaaacaagaacatttcttgcacctttttcctgcatgcgttttgcatatgtgacaacatcatccttatcattgattaccgtgtggaaaatctctcccagctcatgattgtttggtttgatcaaaaacggatgataagcaagtacgttcatcagcagatctctggtcgcatctactacaatattgagtttcttgttctgcagatgttccatgatatccatatacatggattccggcattgtgtccgggatgcttccggcaagtaccagtgtatcgccatcctgcaatgcatccagttttccgtaaagcttccggatatcttctgatgcaatctttggtccctgtccgttgatttccgtctcggtctgtgcccggagttttacgttgatacgggacaatccttcggtaacgtgaataaaatctgcggtaacacctttctcctgaagaagccgtgtgatggcatctccggtaaatcctgccataaatccaagtgctgtgctttcttccccgagatttttcagtaccattgaaacattgattcctttcccacccggaaaaataatttccttgctggtacggttgaccacaccggtcataaagttgtccacatttacaatgtaatcaatggatgggttaaatgttacggtatagatcattctttcacctccacaatatttttgtattttttaagtgccggcttgtacagctccgttgttaagatggttgcctgttcaaaatcagcaaatttcacactggaaagctggtcaaacttgctggcatctgccagaatatagcagcgtttgcaattcttcatggaatatttctttaccatggcttccttgatctccggggtggaatatcctttgctgacgctgattccgttcgttccccagaatcctttggtaaagttatacttggaaagcatctccatggcttcctccccgacgatcgcctctgtctgggatttgaattcgcctcccagcagataaacacggcagcccttttccgccagaagctttgcatggctgatggcatttgtcacaaacaccgcctgtgtctccttaataaaagggatcatcgcctcggtggatgttccggcatccagataaacaaaatcatccgggcggatgagtgatgctgcatactttgcaattgcattcttttgttccgcattcatcgtcttacggtttctgacatcctcatcatgtgtactcacactcggccgtctggcgattgcaccgccatgcaccttggtcagaagaccattctcatccattgtaattaagtcccggcggacggttgattctgaagcgtcaagtgcagtcataagttcctgtattgtggcacttccctccgcttctattatggacagtatccttgaaaatcgttcttctgcaagcatatgcctcactcctttgttttctttttcgttcacaatctttcaaaaacgttcattccgatggttcttattatagttacattttctgtcatcgtcaatcactttccgtcaaaatcattcacaaaaacagaactgggattttgtgcataatgtcatttaatatagtggctcgaaaggacagggcatggttcagacagaggcaatccggctcatgctccttgcaattaagaggctgtaggaatttttatttcaattattatcaggcggacgcaaccggtggtcattcgccttccgggctcagtgaccacctgcctcgtacatccatgtacgaggcttgctgaaaattgaaaaaattccaacagcctctaaaatgcaggagaaatcgccgggttgccattggtgtccccctccccggtcctttctacctagcagtttacagtacaattgtttcacaccatgtcaaaagcctattatgttttgtaaaaagaacagcatacttattgagagtatgtgtattatttgctacaatatccccggaatatgacaaaacaggtttttctgtgagtttcttggtattatcttatagaaatgcagaaaattttattttacaattatccattacaaacacaaggaggaattatcatgagaggcgtcgaaacccgaattcaggaaatccgtcacaaaatttttacagaagtagcccgtatggcttatcataccgaatggcctgtaaaggaacgtatggaagaacttccatataagattattccgggagaaaccggaaatttcagaaacgatgtatttttggagcgtgcaattgtaggtgaacgcctgcgtctggcaatgggtctgccaaaccgcagtgctgcagagcatgccccggtatccgatggcattgaagctgctgaccaggcagaaacttactatactccgcctctcattaatgtcattaaatttgcctgcaatgcctgtcccacaaaacgtgtgcatgtaacagacggctgtcagggatgtctggcacatccctgtatggaagtatgcccgaaaggagctgtttccttagaccgtaccaccggcagatctatcattgaccaggagaaatgtatcaagtgcggccgctgtgcaagtgtctgctcctataacgccattatcattcaggaacgtccatgtgccaaagcgtgcggtatggatgccattacttcagatgaaaacggcaaagccaatatcgattatgacaagtgtgtttcctgcggtcagtgtctggtaaactgcccgttcggtgccattgctgacaaatcccagattttccagacaatccgtgccatccagtccggtgaaaaggtttatgcagctgtcgctcctgcatttgtcggtcagttcggaccaaaggttacccctggcaagctgcgtgctgccatgaaagaactcgggtttacagacgtttttgaggtagcaatcggtgcggatctgtgtgcaaagcaggaagcagaagatttcttaaaagaagtgccggatgaacttccattcatggcaacttcctgctgtccggcatggtctgtcatggcaaagaaattattcccggatcacgccaactgtatttccatggcactgactccgatgacattaactgcacgtcttatcaaaaagcataacccaaatgcgaaggttgtctttattggaccatgtgcggccaagaaactcgaagcaatgcgccgcagcgtccgcagcgaagtagatttcgtgctcacctttgaagaaatggctggtatttttgatgcaaagcatgtggatctggaaaacatggaagaagatccggatggtgtaagtgacgcttccaccgacggaagaaactttgccgttgccggtggcgttgctcaggctgtcgtagatgtcatcaaacgggatcatccggaacaggagatcaaggtggcaaatgccgagggattaaaggaatgccgtcagcttttaaaacttgccacattaggcaaatatccgggctatctgctcgaaggcatggcctgtcctggtggatgcgtcgccggagccggaaccatgcaggcaatcaagaaatcccaaacagcggtcggtctgtatgccaagaaagcaaaccatcagttctcaagcgaaaccgaatacatcaaagaactggataaactggtggattaagtatctgccatataaaaaagccctgcgctttcggaaattccgaaaacgcagggctttttatctgttcttttattctacttcaattcccgtatcaaaggtccatttccactgaccaaaggaagatgtgtatctgctggttcctgcaatatcattatcaatcatgattccgctgcatgtagaatgaatccgccagtacctactgtttccatacttatgcacaatcgtgcggccactgtaactgtacttatctcctgcagatctcttaatcgttcctttcgcatagacaccaatatcttccagataatcctttaccgcttccatcgaagaaaattctccgaaatatatggctatatgggaggaagaaccgcccttgccataaacaacaacatctccaagttccaactgggaaaggcttttcccactgctttttcttccaatagacttctttgtgccggaattccactggatcgcaccctttgttgcaacccctgttgtatacgaaatactcgatccgcttacccagtctctggtacaatgtgctccaacactgacatttttcagtgcagtccctttccgtcccttactctccagacgattcagagctgcccgtgtgtaaccactgcagtcacagcggattccatcaaccacactgccataactctttcccagaaatcccttacacaatgttttccggtaattatcctgtgccacaaccgcggtacttttctttcctgctgcttctgccggtgctgcagtaccccctactacaactgccgccagcaaaatacctgcgatcagcttcttaccccatgtaaccttaaatttcaatgcctatcctccaatttgttacaactttgttacttaactataacatatagtaacaaaaatcagaggctttttcaagaaaaatgtgcaaaaaagtttcatttttatctcattttttatgcttttttaatatttttgggtctcaatctcctggaaatcatttttcatatcatacgaaataagtgaaaaatcatcccgttccacatgaagcacataaaaacggtcacccgaagaaagtcccctcatctgttctgcaccggtccacgtatccattttctgctgtgttctctttaaggaaattttctttacaaaagacgttccatcccactgaaacagcatatacctgttataattggttttggtccaggtctctgtcgcaaatccgaccagtccacgtccggtatctacaaatgcacacttgtaattctctgcggcactacagaaatcttcgtttatcgtcacagaatccaaaatcctgaggtttatcggatcggagatatcaaacattgtcagttttacccctgtcttctcgcttgtcttagcatcggtttcatagccgatgccaagcaacagtccatctccaaacgggtgcagataatcggaatatcctgtcatcttcacatttcccagcggcttcggatgtgccggatcggaaatatctactgcaaacaacgggtcggtattatgataagtaatgaaatatgctatatttcccagataccgtgccgcataaatctcttctccctttgcaatattttccagcaatccctcttttttcaggtccgcatccagcagatacaggcggttttcggataaagaatttggggaatctgttgtcagaatacgaagttctcccccactttccgaaatagcaaacgtatcccggatcgccccctttacggttgtttctgcaattgctgaaaacattccattcttataagaaaacttggcgatctttgtcttttctccacgctcatattccatctgatacagatagattgcatccgttcccatataaacctgtcgtccgctgtcgagaagcaccatatggtctgcagccttcgatggctctttaagatttacagatgccataatgacttctgttgtcccattcttctgcacataaaaacatctggcatctgcttttttcccggcaatttccggaatgacctgagccttccagttctttccgtctctggacacccaacggtcagtaaacagataaataaaatttccaaccttacgggaactctggtatgctccatccattttcatggttgcacttaataccggatttgcgcgttcggaaatgtcatacgtcaaaagaactgtactcacatttccgtccggttcatatttgtaacatccgataaaaccggaatcattgtcagcctccgtgctgtcggactgaatctcctcctgttgtgtttcccatccctgcttgataacatacagccggtcattatccacgtatagctgcaaaaggatgtcattttccgtcagttccggccgtatttccgacagcttacgcatatttttgtcccgaatatccacaatggtcacccggtcatcattcagcacatacagataatttccgtcatttttgacgatgtccccctcgtccacaccgtttacctgcaaattggtgtcggaatgggtaccggatgactcttttttcgcctcggcagaaccggtatcttccacaaaaaacaaatcatccactgtgccttctgccaactccttttgtgaattggattttttctgtaccgctgcatatacatcctggtaactttttgccagagtaaatgcaccgatttgttctttcttttctgtatcctgcgtactgtcgacagtttctgttacggaaagagcagcctttttcggttgcgcatcatcggttccatacttattccatccataggttccgaccgcaatcaccagcactgcaactgccgcagcaattccggcaaatctccggtaatgtctgtgttctttcctgcctgcggatgtccgatttttccgctcctccagcatctgctgcaccgccccgggtgtcagagtatccggcacggtaatctgctctgcggatctgtctattttctctttccattcttccaggttctgttcctgcatattctcacctcaatcccttcagctgtttttccatccgctgcaacgcccgatgttctctcgaccgcacagtattctcattcattgcaagaatctgtgcaatctcccgcgtcttatatccaccgaagacatgcattcccacaatcatgcggtcctcctcatccatcgtaagaaatgcacgccggacttctatatattcctcacgggtatcaccccatacatagccgtcccagccaccgttttcttccgtcagttcttctccccgttgatagtattcccgcattttctgtttgcacatatttgccacgatacgatacatccaggcggaaaaagcatcttccttccgcaattttccgatattttcaaatgcttccatcacagcggcactgaccacatcctccgcatcctgtgtatttccaagcgtatacagcgcaaaccgatacagcctcttataaattgtcccatacaattcggcaaacgctgcggtgtccccgcgctttgccctttttactaataaacgttcatccatggaaggccctcctatctatacagtgtatcggaggtgtatttttgttgcaagaaaataaaaaaagccctcccgtcaaataggggggctgtttcgttcctcgatcaggaatcttttttcgccttatcaatcatataaagaatatctgcaagctcatcttccggaattttgacataatccgcaagttctttctgcgttggctgtgcaccgttctgttttttcagatagttcaccgcttcacttaccagcgctacttttccaaccacggaattttcattctcatcctcaccggtctgttcccggatgcaggatttcatcgcttcttccaccgcgataagaagttcctcttccacatccactttttcgtggctgccgcacagctcgctcaggcgcaggaaaagtgccatatttccttcctgcacaatatcctcaaatccttccgtggaaaccgccagtttctttgctacttccagtacgttgcgcagccatgcattggagagcgcgtgtaccatgctctcttcccctgccagcagcttcttatacatatcaatctgctgctccttggtatactccggaatatctttcagttcctccagatacatctgaaacatgggagaagtggaaatgttgtctgtgacggaatcttttgcggattcctttttcgcagaagattctttggtttcttctttctctgcggtctcctcatattccgcttcctttgtttccggttcgttctcttccggctgcggatcatcatgtggtgttgacagaaactctaacaccatctcttcctgctgtgcattcaaatccatatccttaaaataggaaaggatctcctctctcgtcatcggctccgccgaagtgcggataatatcctgtaccgcacgtatggtttctgtaaatgtattctggtctaacatatcaggtctcctgttcctcatcataacattcgcttctgatccgcgaactgatctcctgcagacattctatgaggatcggattaaactgtccgcattccccatgcaggatcatttccagtaccttttcatgcggtactgctttcttataaacacgctcactcgccagcgcatcgtacacatccgctacagaaactacctgtgcggaaatcgggatttcatctcccacaagtccatccggatagccttttccatcgtagcgctcatgatgccagcggcagatctggtgtgcgatctttaccagtggctcgtcctgataaataccaagctgttccagcatttctgcaccgatgacagtatgcgttttcataatctcaaattcttcttttgtcagttttcccggtttattcaggattttttcatccacaccgatttttccgatatcatgcaaagaagaagcaagtgcgatcatggctctggtatccccatccagatgatacttttcggttttctgcgccagtctctccagaagcatctccgtaagtttgtgaatgtgaagcacatggcttccgctctctccgtttctaaactccacaatatgactgagaatatgaatcagcatctcgctgtttttctctttttcgttgatctgcgcggtaatcagggaagtcagccgacgttgcttcgcatataatttcatggtgttcgtcacacgctgataaacgatctgtgcatcgcatggcttgctgacaaaatccactgcaccaagtgcatatgcccgcttcacagcctccggggcatcggctccggacatcataataaccggaatatcctcaatccagtgatttttattcatatatgtcaggacatcaaatccatccatcttcggcaataccacatccagcagaaccaaagaaatactattgacctgctgttccagtatttctatgcatttttctccgctctccgcctgcaggacatgataatccttggaaaaaatcatatccagaagcgtccggttgacctcctcatcatccactacaaggatctccggaatcatcttttccggttgcttctgtgcgtgtatctttccctcatgatcaatcatgttattctcggtgatggccatgtttttcttattttttgcctgatacatcagtttacgtgcgcgaagcattgcatgctcaacagattcgttctgcgaaatcacggcacccatactgacagaaagctgaatattggaataccccggaatcactgcattctggatcttttcctgaatctcctgcagtttttctaccagcccatcttcctttatctccggcagcacaagaacaaattcatctccaccatagcgcacaagcgtatcctctctgcggatacaacgccagatcacaccagcaaccgccgcaagtgccatatctccggtcagatgtccatatgtatcattgcaaagcttgaaatcatccacatcaatcacaacaattccggcatttcccgtccacatttttatctcttcctcaaaatacagacgattataaactccggtcaggacatccttatataatttttcattatatccggtcagtttattgatcagcttttctctgcaggatatgtcgattaaggtgtcgtcctccagatgattgatcaattccatgacgtatggctgtccatcaatttccatataccgggagattacctgatagacttctgattcaaggaattccagcttaatcatctgcttcttttcccgcaacgctttataggaactgcagttttcgcacttaccgtttttcttccagagactgtagcacggacatccatcctgcacattttcgcacgttcctttcccttgctggtaaaatgtccgctcaacatcttctccttttaacagacgtgctacctgaaaaatcttctgataatatttgatttcctgttctgcttcctgcatggtcatcccgttaccggattgcattacacctcatcctcctggcattagaaattcaagtcaattttaatccccttcagatcctcgtttacgagattgttctttttaagaatcgtctggatgtgctgctgcgcctcctccagcttactcgtacccgtctgattcaccgttacatctgcctccagcctgtctgcctcgacagaaccctcaatcatcttctcctgctgctgtttttcctctttcttttcgtcaatcttttcctgctgctcgtcgcgcttctcctgcgcttcctctgctttctctttctcttcttcctgtttctcgtcgatgtgatctaccgcatcctgtatcagcatgccaaaagcatctttatcggaagcatccagcagttcatctgctgcatcctgcgctttttgcatatcctgtgatttcagctggtcgagctttgcatctgccgctgcctcagtcagagaagtcacgttacgctgcgccctgtctttcttgttcagaatgacatccctttgtgcattcagctgtaatgccctggtctgataatcggtcagaggggtattctgcagttctttcaaacggtctatctcttccttggaaaagtcatccgtctgcacacctttctgataatcctgatatttttccagcagttctaagtctttctgctcctgggaatccgaatccaccccataactctgccgcgcgatttctttactctcgcgaatctgtttcaattcctcgttacactcacggacttctttgagtttttcctctttctgctgtgctatctgatcccgctggcttaccgccttgttatcactgtcccatgcatcccggatcagcttcatcgcctgtttccgggcgctctgtttcttgtcgcttgcagcattgccagtggtctgggcaaactgcagatctccggcatatatggttcctttgtcggatactttgtttttgcgcgtttcatcgtctccgatttcgtatgcattcatgttagcatgtggtgcctgaatcgtcaatgacatatgataattccccctttatttttacataatatcatcttatatatcggacattttctggaatttctccatatatccggctaaatattgttaataggaactgctgtctttatactgctgctcatccaccagattcagtcacacgctctttgtcggaagacgcaaaataatataccgaagcatccgacttctgcagtgttttcagataatcgccaatctcttcacagacatcttccaccacctgttcaaatgcatccagatccgtctgctttgcaccgctttcatatgcctcctgtttgatttcttcctccgtctgcgttcctgtctggctgtctatatacttgcgcaccacaagattctgacgaataaccggctccatattcttccagtaagcactctctccaccgaatcccgcataaaaatcgcggatttctttccggttctccgctttgttcatctgtgtcttcagcagttttgcataatcatcatattcctgatccgacacagtacatccgttcttttttgcaagtacatacaacgtcttttttgtaataatatcttttataacctctttttttgcggtttttaccgtttctccgttttccacacgtaatgccactcctgcctggatttcctgctgtgttaccggaattccctggatacggtaaaccacctttgcagccttccccgtaaatctggaaacaattgttccaagccggaaaaaggaagttcctccccctacggacaccccgactcccgccaaaacaagcatggcaagaactgctgcagctgctctccatttaaaagaagcctttctttggtgcatgtcatgttttggcttatatgtatacgcttcctctataatgtcatcactaatttcaccgattgcatcggataatttttcggattttctcataacactacaccctccttctccagtttctttctcagctttttgcgcagacgcatcagttttacggacacactgttttctttcatcccaaacgtttccgcaatctgtgcgacagactccgcataccagtaccgtttgacgaacatcacgcggttgccggtatccagttcccgtaaaaagcgttccaggactttcgtcacctcctgttcttcccacggctcctgctcctgcgctgccggaatacattcttccagttccgcaagcgatacatcgtaatagctgttgcgctttgccgccatgttatgccgcagccttttgacggacagattgcgggtaatcctgcagacataggagaccagcggattcggggtctgcggtgggatgctgttccacacaccaagccacgtatcattaacacattcttttgcatcctcttcgttatttaagatccggcgggacaggctctgacagagttttccgtatttctgcgacaattcggcaattgcctgctgtgaccgctcctgaaataagcggatgattgcagtatcttccatgatgattcctcccttctgttggatgccagtccttttaaagccacctgcggctgggactggagcatctcttatctgtatactaccggtttctggcgggatgtgacggacagatgtgtttttgtaaaaaaatagcatctaacatttctgttaaatgctatttggacaccaatttaaattatatattacactgacttcttttttacaatctgtaattcatacccgagagcatctaagatacgactaaatgcccgaattgtcgggatactttctttcctttcaatccttgatataacctgttgtttattccctgtcagcaaagctaattccttttgtgtaatttttttctttttacgtaaagaaatcatttcaccaatcaatctatactctgcacgggactcatcccatatttttttaaactccggatcgttctctctttgcttttgaatttcctgctctacatttacttgcaaaaaaggcatattgaccactccctctaaataaacttcctgcctaacatatttcctaattcttttgcccgcttccgtactatatttgcatcctttttttctgttttatttttctgttttcgacaggaatggagcagatatatattttccttatctactgtaatatagaatacacggttatttttctgaaaatatacctcatacactttcttttcccatcttttaaaaagaattttatcaaattctcctttttccatatgctgcagtacggtataaccatcaattttttcagcttccggaagactattaatgtattcatatattaaatctcttcccgaattcgaaagataattgtgtaatatcatatgctgtctccacttttgttttgtaattacaaaatacagcatatatgttgtattgtcaagagttattctctgtcttatatatctttttcacttaatctactacggttcatcatttctccttcgaacagttattcctaatcaagtccttccccaagaagtcccagccccttgcgatccgcaagactctgtgcgccttctttaacttcctccttcgaataatcgtgctcttcaagaaattcctccggaagttcattcagataatcgtaaaatccgagtgctacttcaaatgtgccctcttcatctctttctaattcttcatacaagcgattttccgcttcattgatttttcctgcatcgaccagtgcaatcagccgggcatataaactgtccgttgctgtatgacgatcctcttccttatattcataggtcgcggtgtttttcccaaataaaatttttgcaagcatgcgggtcatgtcacgtacctgccgcataataatatcattctcgtatgccatgattgttgatttcctttcttttttgctgttgtgtttccggttattgtgcctttttagtagctgtatattttttcaaaaaacagtaccttttctatcgctatatcttttgggctattataagtttcctgtaattataaaattcacgatgtttgtgctggcaaatggcaaatatgttttttactggttgattatgtcctgcttttactggctggtgggactttttgcaacactttttctgcatatgtcctgctcttgctacctcgagggacttttcgcgccacttttcctatatatgtcccacacccctcatattcttgaaaacccggctttgataaccacacttattcactctttctcatcttattatacacactctctatatattatcaatcatcctacatactttgatctatatatttatactgttgtcccaatcatatagaaaaaacacttttaatctttacaaaaaatatgacccacctatttatgtgaagcccagcaaaagagatttttttgcaaaaaccgatacagttcctcatcgctccgtatatttacccgttctgcccgcagatactccggcagactgttttcctccggatacatcccacaaatatccactccgatcacatcatattccgtaaccagcgtttttaatatctgttccagcattcccattgacatttttccctggtcccagtttgtcactgcatatttttcgtccagcacatccttgtcgatggaaatataaacagggacttcatccggcagttcttttattttttcatgtgcttttccgttttttaattcctcgtaactgatttcaacaagctttccatctgtctcctgctgtctggctccggactgtaacttatcaagcattttcttctcctgcccgatcaaaaccagcttttgcagatacgggttttcctgcaatacctttttcgcccagtttccgcaacttaagatatctccgcccagacttgcatcctgcatatccgtgtgatggtcaattaacaccagcgtaaacggctccttgataaaatccgtcataattttggaaatataatgataatcccccgaatctataaaatgaattccggatactccggccggcgcaatcagcgcttttattttttcttccgcatctctgctgcaatacagacggctgcctccgatcgcactgcagtcatgccactccagtcccggttcttttcgctttggatagcattgtgtaaaatcaaagatcatgtttcggtttttcaaactttcatcctccctttttcacaggcgattgcaaaacacgtgtggcacatgcgcattctttgcaatcgcctgcgatatattataagaaaaaggggacagcctctcgactgtcccccttctgaataattagccttcaatagaaatatacttcttttcttctaccttcggtgcttcctctttctttggaacttccagtgtcagaacaccgttttcaaattttgctttcacgtcatcctgcgttactgcatcgccgacataaaagcttcggctgcagcttccgctgtaacgttccttgcggatgtacttgccatccttatccttctcatcgttattcttactggtggttgcggttacggttaaataaccatcctttacctcacctttgatatcttccttctggtatcccggaagattcattgttactttgtatcctttatctgtctcagacacatccgtctgcattgttccgtttgatttgtatgggaaaccaccaaagaaatcattcataaaatcgttaccaaaaatactaggcattaacataagtcatctctccttccaaatcttaatcatctattttattatcaaagtttcaagagattattcatttctctcaacctcttttccctttgttcatgatatgttataccaccgtttttagcactcgtcaagtatgactgctaacaatttttgtgaagattttgtgaattttctaaattattctgaaaattatattattttagcagaaagagccatcgttttcatagctcattttcatgtaaaatatgctgcatttatgttacattatataaatatatgaaaaaataaaaaatgctgtaacgaaacaccgtatttttacatcaataaatgtaacccatataaattccagaaaaaaggaggtcgcacatgcaggatatggacgcagtctaccgtcagcattttcgcatggtgtatcagtacctgatgtcactgacgcaccagccggatgttgcggaagaactggcacaggaaactttctgccaggctgtcagcagtatccaccgctatgacggaagctgcaagatcaccacatggctttgtgccattgccaaaaatcaatatctgtcctatctgcgaaagcacccactgcacgaggatctgacagacaccgaagcggaacttccgcacacaccgtctgcagagcaggaggcgctttcctccgccggaaaaatggaattgctgcaatgcctgcaccagtttcaggaaccctaccgggaagtgatctatctgcgggtatttggaaatctctcgttccgggaaatcggacaaattatgggacagagtgaaaactgggcgcgcgtgatgttttatcgcggcaaggagcgcctgcgaaaggagctgaaccaacatgaaaaatgatttgacctgtgaggtcgtacaggatctgctgccaagctatgtcgatcacctgacgagtgacgtcacaaatacggcgatcgaaacacatatccgggagtgtgccgactgtcgccggatactttccgatatgcagactccggaacccgtgccggcagaaacggcaacggatgcttcaactatcgactttttaaaaaagagcaacaaaaggaacaagcgccggattcttgccgccatcctgatcgtgacactgttgctcggcagcatctggggatatcggacgtatttctaccctgcaccgctgaaaaataccgcactgatcgactatgcggttaccgtaaaagacaataaaaccattcagattaaaggatctttaaccgatcagacacttggtgttgccggaatcgactactcctgtgatccggatcacccggaaaccgtcacaatcaatgtcaaaaccaaccgcatatcggcagccgggcacaatacattttccgataaaaagacagaaacccatgccgtaaaaaaagtatatgtaaacgatcagattgcatgggaggacggcacctctattctgccgaaagcagcacagatttatgccacgatccatccatacgtcggtgatatgtctgccaatgaaaaaacacttgcggcacttggcatctccaatgtattttcgattgcaaacttcaaactgcagaccacggaaaccccttacggctggaccatatatctggatgacgcatttacaaaaaaacaacagaccaccgttgaaaaaaccatgaaaaactatgccatggtcattctcgcctgcaccaaaaatctgggaagtgtaacgttttcctacacattggatggaaaaacgacagattttacttatacgaaagaacagggagaaaatgaatttcttggcacctgtaactacttccgcagttctgccacagagtttcagacactgcttgcaaaaaccggcatcttaagcgatcccgtcttttccagactgtccggaaaccagggataccgcctgacggagcagctcaacaatgttccggatgcggaaattaccgggacgattcaaaacgaaaaacaaaatattattaagcaatatgaaagttatctgccgaccaacagctggtcgccgggatcaatcagcaaatcattttcttccgaaaaagatgcactcgcttatatcggatacaaaaatctgcggtcatttgccctcccacagaaagcagacagcatttccgtcaacgcaaccgcggataaaaaaggaaacatctgctacatctcgctttccgaactatacagttgtgcagacggacagatcaatgtgacggccgccgccgatctctatacagaatcatccaacatcggttcctatatcgatatggactatccatcgtatgaggaaacgccggatgccgtatccaccaacgaactgtacaccacggcttccggcgatacctggcaactgattacgaccacctctcagggtgatgatttcaatgattccatagacgcttaccggaccgaagacacgattttatatggcattcacatcggttacccgtcgaacctgaaagaaagcgcacaggcagaactgaaaaaaattttagaaaacggcatcggccagaactaagggatttataaaaaattaagaaacctttttcaaaaaggtattgagccagaagaaaatgttcattataatccattataaaacaataaggtgaataccccggccgtatccgggagaaaggaaacatcccatccagtctgactggatgggatgaacattgataaacatgaaatggatgatagcatctgatatccacggctctgcatactactgcagacagctgttaaatgcatacaaccgggaacaggccgaccgtctgctgctccttggtgatcttttataccacggtccgcgcaatgatctgccggaagaatatgatccaaaacaggtgattgaactgctcaacgcaaaaaaacaacatattctctgtgtccggggcaactgcgatgccgaagtcgaccagatggtactccaatttcccattatggcagattactgcgccattgcagacggtgatacgctgatttatgccacccacggccatacgtataatgaacagaacctgcctccactgcatcgcggggacattctgctgcacggacatacccacgtcccggcatgcgtcccacacgacacatatacctgcatgaatcccggatctgttgctattccaaaagccggaagctggcacggctacatgattatggaaaatggccgtttccagtggaaaacaatgactaacgaagttaaaatggagtttgcagacggaaaacgcattctctaaacaaactcttttacggaagcataaatgccttctgcattcagaccatacttctcaagcagtgccactgccggaccggactcgccgaagcagtcctgtacaccgatgttctttaccggtgtcggtgcctttttcgaaagtgtctcgcatacggcggaaccgagtcctccgatgacggagtgttcctcaacggtcacgactttaccacattcttttgctgctgcaacgacaagttcctcatcaagcggtttgatcgtatggatgttgatcacctttgcatcaatgccgtctgcggcaagcttttctgcggctgcaagcgactcggacacacacaaaccggtcgcaatgattgccacatctttgccttcccgcaaggtcacacctttgccgatttcaaatttgtaatccggacggtcattgatgatcggaactgccagacggccaaaacgcatgtaaaccgggccttcgtgttcatatgcagcttttactgctgcttttgcctcgatatcatcactcggatttaagatgaccatgcccgggatggtgcgcatgagcgcaatatcctcattacactggtgcgttgcaccgtcttcaccgacggaaattccggcatgggttgcaccgatttttacattcaggtgcggataaccgacagagtttcgcacctgctcgaatgcacgtcctgctgcaaacatggcaaacgaacttgcaaacggaactttaccggttgcagcaaggcctgctgcaatgccgatcatgttacattctgcgataccacagtcaatgtggcgctccggaaattcctttttgaagattgcagtctgtgttgccgctgcaagatctgcgtctaaaacatatacatcatcatgctcctttgccagctctacgagagcgtttccgtagctgacacgggttgcgatttttgttacttctgacataatgcttcaccttctttcttcaggtcttccattgcgatcgcatattcttcatcgtttggcgcttttccgtgccatcctacctgattttccatgaaagagacaccctttcctttgaccgtatgcgcaatgattgcggtcggctgtcccttggtgtttcttgcctctgcaaatgcagcggcgatctgatccatgtcattgccgtctgcaaggtcaaccacatggaaattgaatgctttgaatttctcgttgatcgggtacggagagcatacctgatccaccggtccgtcgatctgcagtccgttgttatccacgatcacaacgaggttatccagtttgcggaatccggcaaacatggcagcttcccatacctgtccttcctgaatctctccatctccgagcagtgtatacacacggtaatcgtccccggaaagtttggcggacaatgccatgccgactgctgcggaaattccctgtcctaaggaaccgctcgacatatccacacccggaatgtgcttcatgtccggatgtccctgcagatacgaaccgaggtgacgcagtgtctttaaatcctcgaccgggaaatagccgcgcagtgccagtgcggaatacagtcccggtgcagtatggcctttggacagcacaaaacggtctctgtccggtttcttcggatcttttggatcgatatttaattcttcaaaatataaataagtaaaaatatcagctgcggaaagcgatccgcccggatgtccggctttggctgcatggacggcagtcacaatgcctttgcgtacttcatttgccttcagctgaagctcctgtttgttcatgttcgttcctccgtatgcgtgaacatcagcccatgaaaattgcctgcggcaatgggctgacgctacatttcagattttcttcgaaaatctgaaatattactccccaaaaactgccttgtagtctgcctggaatttttcgattccctgatcggtaagcggatgctttgtcatctgctcgataaccttgtaaggaatagttgcaatgtcagcgcctgcaagtgcgcagtctgttacatggatcgggttacggatggatgctgcaatgatctctgtgtcatatccgtaaatatcaaagatctctgcgatctggcggatcagctcaatacccggctggctgatgtcatctaatctgccaaggaatggggatacatatgtagctcctgcgtttgctgcaaggattgcctggtttgcgctgaaaatcagggtaacgtttgtcttgatgccctcagaagaaagtacctttacggctttgagtccttctacggtcataggaatctttacaaccatgtttggatggatggctgcgatctcacgtccctctttgatcatgccctctgcatctaccgttgttgcctttacctcaccgctgatcggtccgtcaacgatggatgtaatttctttgatgacttctgtaaaatctcttccctcttttgcgatcagggatgggtttgtggtaactccacagataacacccatatcatttgctttcttaatatcctctacatttgctgtatccacgaaaaacttcataataaaatacctccatttttatttacgtttgtttttatctgtcagccttaatatagcacagttcaaaagcaaacgcaagtataaaacaaaagagaataaaagttagtgcaaataaataaaaggcacggatacggttctctgccttttgacagaaaacgtatctatgcctttttatatcaaaacagctttctttatgatggaaaccttttatattccaagcactcctgcagcactgcgcagttccgcggctgcccgctgcagctcagccgcctgctcttcggacacatttcccggctttgtacggctgaccagtttctttacataagaaaggctgctcttgatctggtgacgcgcaccactgtcgatggtctttttcttctctttataagctacttccacctgacggatcaacgtgtcggcctcgcttcgcgcatcaatataagcctttctctgcccgtctgttgcttcatattccgcggcttctcttatcgcgcggtcaatctctgcgtctgacaaattagaacttgccgtgattgtgatctcctgatgccgtccagttcccagatcctttgcggaaacctgtacaataccgttcgcatcaatatcaaacgttacttctatctgcggcacacccgccggcgccggtttaatgccccgcagctggaaccgcccaagcagcttgttgtctcttgcaaactgacgctcgccctgcagtactttgatatccacagatgtctggaaatttccggcagttgtaaacactttactgaaccgtgtcggaatcgtggtattccggtcaatcagcttcgtcgaaacacctcctaccgtctcaatagaaagcgaaagtggtgtgacatccatcaggataatctctgccgcctgtgatcctgccatcagcgcaccgccaagttttccaccctgcacagccgctcccagtgccacacattcatccgggtttaaattgcgtgaaggttcttttcctgtcagtctgcgcacttcctcgaataccgccggtacacgggtagaaccacctaccagaagtaccatgcccagatccgctgccgtaattcccgcatccgaaagtgcctgctgcaccggacctgccgtgcgctcaatgagatccatcgtcagttcctcaaattttgcacgcgtcagtgtcatttccatgtgctttggctcaccctttacggtcgcaataaacggcaggttgatgcccgttgtggaagaggaggacaatacctttttggccttttccgcctcctcacgcacacgctgcatagccgtcgcatctttccgcagatccacacgctccgtgcgctggaattccgataccagatactccgtgatacgcgcatcgaaatcatccccaccgaggtgattgtctcccgcggtggcaagtacttcgatgaggttgtccccgatttcaataaccgatacgtcaaatgtgccgccaccaagatcatacaccagaattttctgtggctccccgtgatccagtccgtatgccagtgccgcagatgtcggctcgttgataatccgaagaacatttaatccggcaatctttccggcatcctttgtcgcctgtcgctgggaatcactgaaatatgccggtacggtaatcaccgcatccgaaactgtttcccccagatattcctccgcatcttttttgagtttgcgcaggatcatcgcggaaatctcctgcggcgtatactgtttgccatctatttttgcccggaacgcacttcccatctcacgcttaatggagaaaaatgtccggtctacattgacagctgcctgtcgtctggcagcatctcccaccagacgctctccgtttttggtaaatgccacaaccgatggtgtggtccgcgagccttccgcgtttgtgatcacaaccggctgatcattttccaaaacagcgacacagctgtttgtggttcctaaatcaataccaattaccttacccaaggtctcttcctccctacacttcgtaatatatacaactgtaaggctggaaatgccatgcgtcaaggtttccggcagatatttcacttattgtttatacttttcataattccttctgaattaccacatctccgtgatacatcaggaagcgaagccccacggtctttttgagatctccatgtccatggtgcttcatgtttcctgccacaactgcaatattggcatctccctctgtatttgtacggtcaaatgtaaacagggtggaattatggtattccaccacctccgtatccactcccagataatccgacaattccgcacgcgccccgatccgcaggatatgtcctcctgcaattgcgacacccccgtcaatttcttttttgctctgtgggattaccacaccgtcgcagagtatgatcatttctgcatccatagattcgcctccttttcgactcttttttcgttatataaaagaagagcttcctcttatccgagaaagctcctttgctaatcacctgttctgtttacgcctactgtagcagaaaacgattggaaacgcaagtacactcccgtacctttttcatactacaaaaataccaactgccaatattcttcctgtatactctctgttcccggcaatctttggtgcaaacctgagtgcatactttttatcttttatttgtgcaatagcctcatccggtgtatgatctacctttaattccagaatcatacaatcagcagttttatcacttctgtgttatgggcaaataacgtcaaaaatgtatttaccacaaacagcgaaccctcataaattccttaaaatcaggcattcgctgtttatgtccaacaatttcacacgtggtttagtaaatgaaacttacctggtcagttaaaactgcgtacttgataatgttttcttactgtttattgtgtcaggcaccacatgtttcaatatttctacaacttttcgatgtccgtaaccagcatatcaacctcgtcctccgttgttgcccagctcgtacagaaacgctgcgtatcaccttcgtcttcaaaataatacttttgcgcaagctcctgcttctgctgctccgtcagaataacaaactgctggttggtaaagctctccaccgcaaacggaacacccttgtcctcaaacgctttcttaatctgcatcgcaagcgcatcggcgcgcttcgcagcctcaaaatactcgccgctctccagcatcgttgcaaactgcagtcccatcagccagcctttcgcaagtactgcaccgttctgcttcatgtaggccttaaagcgatacttcagatcctgcgcagtaataatgagcgcctcgccgaacaaagcgccacacttcgttccgccaatataaaatacatccgtcaattccgcaaaatccttcaaagtaagatcatttttctccgatccaagtccatatcccatgcgcgcaccgtccacgaaaagatacatcccatattttgtgcacacatcatggatctccttaatttccttcttcgaataaagtgtacctttttctgtcggaaaagacagatataccatcttcggttcggtcagatactccggctcgtcctgatcgtaatatgccttggcgcaagcggcgatctgctgcgcggtaatcttgccatctgtattcggaagttccagaatcttgtgtccggtgttctcgatggacgccgcctcgtgacagttgatatgtccggtatctgcggcgatcacgctttgcaccgaagataatgcagcagcgatcacgacataattcgcctgcgtggctcccggaatgaatttgatcaatgcatcgtcattatcgaccagcttctttatgatggtttccgctttatcgcaccactcatcttccccgtatccggcgtagcttgtgctgttcgttgcgccaagttccttcaatatggatgcaaatgctccatggttgtaatcgttattaaatcttatcatttcttacatactcctgttcaattagaaaaggcatcaaataaaatggtttcagtaacaagttttcttcctttccagcatccttctgcgacaataaatatatatcatgcacatttttcgaaaactttttatcgaatacctttatcgactcatgttttccagatccagatgatttaatttcgaaagcgttcactttgcttccttccgagatcaggaaatccacttcataataatgcgtactgcctgacttttcccatgtgtgatagaaaagctctctgccagatgccgcgatcatttgtgcaaccagattttcatataagaatccgagattagccggtaatttgtcagaaagcagctttgcgtacacatcattttctgtcaccggtcgatccataaacatcaatgtaacaaacaatcctgtatctgcgaggtagagtttgtaactgtcaaaatcctttgtgtctgctaaactcacacgtggatcggttgaattataacacggcaaaattgtttttgaatcaatcagctcatataataattcctctgtttttgctttactcttcttcccgattgctgttgaaatccgatatttttttgaatctttggcgagctgcgccggaatcgaatgatacaatgcagaaattcttccagacgcatcaattttcttaaaatcatcttcatacaatgatatgatctgtctcttgaccatatcaatttccgagaaattcttaccttccgtgtatgcttctaccgcctgcggcattcccccaacagccatataaatacgcagatctcgcattaattttcgattcgttgcctgtccgattgcagatcctgtaccataaatctggcgcaagagttcataattacctcctgtggcatcacaaaattcttcatagtccatcggatatacctgtatcttcatctcctccgacggaatcaaaatgtcttttacatttttcttaatcgagattagagatcccgtttccagataactatatctgccatctgccaccagatgcttgatagcctgccttgcctgtgaaaaaagctgcacttcatcaaatatgatcaatgattcatgttcgtataaagtcactcctgtttcggcctgaagacgcaaaaagaacatatttaaatttcccacatcctcaaaacaactgcgtatattgtccgttgtctttgagaaatcaatcaaaagataagacttgtattcattttgcccaaaagactccgcgatcgttgatttaccgactcgtttgaccccctcaagcaaagccgcatatttgtctgagtattttgctttccattctaacaatctgtcatatgctttccgtttaaaatacatcattacctcccaaatatatccttgttataacatgaaccgggcatttcttcaagattatattttgcatttttgtccgtttcttcaagattttcatcaaaaaaagcgcccttgtctgatatgatacctctaaagtagacagattaaatatttattgtgtcaggcacctctgatttctgatttcaggtgcttattacctgaaaatgaatattttttaaaaaggctgacttgaaaaagtaaattccagtgcaggggtaaattccaccacgctttaaaattctttgattttttagaattgtgggaggctaaatccttataaaactagttttataaggatttagcctcccacaattctaaaaaatcaaagaattttaaagcgtggtggaatttacccctgcactggaatttactttttcaagtcagcattttttaagatgtttaagcgagagaacaaatcaggatgaatcgaaatagctgaaacattcgggtttacagaagattcgtattctcttgtaatcttttcaaattcacggatggatgatttgatctctgttttagagactttcagtaattttaagtagtaacagataaggataatgtaatcaccgatagtcttgaaatttatgtacggcatcccccatttctaaaatcaggcattgtttcattggtcttgaaggatccatttttttgaaacgggtatcatataccacatcgttgtgagcaatggcattttgtatggagccttgaagatttagtttgttgttctggtatttcttttttatatcttcacgggttccggctggtgcatttttgtagctgctgattgctttatcgtacatatcatagatactgctggaatcaatttctgacatagtggtgttcaaagcaatatttttaagcgcagtttctataaacatcatttttccatataaaagagattttaattttgtatcatattgtatggttgcgttaatctcattatatgaagtgaatggaagtctgttagagaaagatacaaaaaaacgatatcctttatattagtgaaaatatccggtattgattagttgttgcttttgtgaactccctgagatggaaattccattatccctaagatgccgcattaaagcatcaggtgatttacaatctgtatgttctttttgaatgataagaacaggatacaatataatgaccagtgcaagcagaataaaggataagtgtgttgccagaggcagctacctgctcacacattctgatgatgcctcaaaaatgaggaatcttttaatcattttaagtgcataacccgttattatatatatagatattcaatggaaaggagcctgatgcgtgttgagtgatgacgaattagtggaacagattctacttggaaatgaaaatgcagcagaagaattgataaaacgctattatacatctattttacgttactgtaggtggcattgctctaatctggaaaaagcagaagacctgactcaggaaacatttttgaagttgtttaagaatttatccggatataaagggaaaaagaaatttaaggcttatctatacacaattgcaaatcatttatgtattgatgaaagtaggaaggttgagttttatccattagaagatgaagaaaatatagtgcatgagtataacgacatagttcggctagaggatagggcagagataagctattttttgaattttttatcatcagaacaaagggaagcagtcattctacgctttggagaacaacttagttttggagagattgcaaaagtgatgggatgcaatatgcgaacagcacaaagcagggttcgtaatgctttaaaaattatgagaaaggagcaggaaaatgaaagataaaaatttgaagggctatttacagcaatctttaggagaggaagtacaacctaaaagattagaggaaacgattaagctttgtactgaaattgtacgagaacaggaagtgactagggcagaaccgaggacaggtttctttcactatctttcagatgtatttcgctttgaaggtattccaatatttggtttgcaggcagtaacgttatttatagtttgtttaacaattgccagcattgcagacgtgccaaagaatataccaatttttatgccgctgtttgtattggctatcatgccagcaatttttaaaagccagtattatggaatgagcgagattgaagcggtaacaagagcttctggtgcccaaatcacgttagcaaagctggttttggctggggctgctaatttggtgtgtataacaattcttttatgtatggaagtttatttgcaaaattcttataaagagattggacagatggttctatactgcctggttccgtacttagtgtgtatggttgcgttgctacgtttgatccgtttgcaaaagaaacagagtttacagatatgtgcgattgtaatgctgggttcctgcatttgttgggggatgtcagcaagaatattgccatggttatatgaaacatcagcagtgggggtgtggattgttacatttttgatttttgctatgttctttataaatgaaattcattatattgcagagatgagaaaggaaggaaaaatgtatggaattgtcgcttgatcgtttaacaaaacagtatggcaggaaaatagcggtagattgtgttagtgcaaccttaaagccgggagtatatggtcttttgggggctaacggtgcaggtaaaacaacattgatgcgtatgctatgtgctgttttggagtcaacctcaggggaggtattgctggatggaaaagaagtaacttcgatgggggcagattaccggaatgtgttgggttatttaccacaggattttggatattatccaaattatactgcgatggagttcttaatgtatattgcagcactgaaaggaataccgaagaatgttgcaaaaaaacgtgtgactgaattgttggaagtagttgatttaagccatgtggcaaacaaaaaagtaaaaactttttccggtggtatgaaacaaagagtaggaattgcacaggcgttacttaataatccgaaaattttgattttggatgagccgactgcgggacttgatccgaaagagcgtgtccgttttcgtaatctgctctcagagtatgcaggcgataaaattgtaattctttccacacatattgtatcggatatagaagcaatagcagatgaagtgctattgatgaaaaaaggaaaatttgtattgcagggtacggttcctgagttgattcacaaggcaaatggtaaggtttgggagctttctgtttctccacaagaagctagacaatggcagacaaaagcaacggttgctaatttacggcacgaaggaaaagaaattatattgcgtattatttcagacaatatgcctagtgagcgagcggttccttgtgaagctacactggaagatctttatttgttttattttcccacagaggaaggagtgaaatagaatggaactattttggttagagcataaaaagttatggcgaaagaaaattgttaaaatatgtgtgttgttgtgttttgtttattatgtaatttttggaagcatactttcgtttcaatggttcggttttggcagctcagatgactatacaagtgcttttggcaataattttgatggatatacagtaataaaggatagtcaggaatatgcactttcatttggtggagaattgacggatgaaaccttgcagcaaatagtaagtgattatcagcaaatggaagctgacggtatggagaaagaactggaaaagacagactggcagatagttaatagttggctcggaacattgtatccggagcttcgagataccagtaattataaaacgatgataagctatgttgatccggataagttaacaggcttctatgaaagaagacagcaggcgcttgatgagtttttggaggtcagtggtcaggtaggagctgaaaaagagtttttacatcagatagagagaaaggtagaaaaaccatttcgttatgagtgggtagaaggctggtcaacgcttcttggtagtatggttgcggatctgggagttgtgatggctttgtttctcggtattgttttatcctctttatttgcgggcgaatggcatgataatacaagcacactagtattgacgactcgaaatggttgggggaaaatcgctcttgccaaaattcttactggtttagcgtttacagtggagttatttgcattacttgctgtttcaaatgttatatcacagttgttttttatgggaactgccggatgggatatgccgattcagaatatcaagctgattgctgttgcacctatgaatatgctgcaggcagaaatttatgaatatgcttttgtactgcttggagcaataggttttgctggaattgttatgtttatatcagcggctgtaaaaaataatgtacttactttactgcttagtctggctgttgtatatggaccaatgatgattgcagaatatcttccttatggaatgcaaaaagcattagatttaataccattggtaggaagttcaacagatattttcagaactaatacttttcgtatttttgggaagcttatctggtcaccatatctaattattattattcctgtcttgattggtattctatgtatgccattcgctataaagagctggtcaagaaggatgaaggcataaataacaatatggcaaagaaaagagataaaaaaataagttgcgagggaaatgtttgagaggaattatcatagtttgtttgattaggtcaagacgcttcatgagagaatctacggagcgttctggtatttctggtttcttgatgtggcatttggcagccaacttatccataagagagttgatcacagatgcacgagagaaaagcatagggccagcgatgttgttttctacaggtatctctgcaggtcttgtcagaatttcatcggcaaaatccatattgatggccgtatgtgcatccatccaagtttctgcatccatgagatgggatagcttggtacgactcataccggtcttgatttcgtaggcttctctgtttcagatagaagggcacggttgatggactgttcccaacggacaatccaaggttccaaggtgtacttcacaaattcgagagattgctgctcaatattagaaaagatgcgtcatcaaagtctctcggaagacaaagtacgtcatttctggatttggctcatcgtgaatcagtcgatacagaggatgcttgattgccttttctttactaccggagtcagtatacttataaacatggaccggcagtcctgcaatggaccccgaaagaatcctgacgcaggcatagactgtagtcatttgcatggcacttcgttcattgacggctttgtcagagttgcttccaccaaagagaaaacgataggagctgccattggtgctattggtgggcttgtctctggaatgaaatagccccgataaaaatcccataaatattcctttctgccttaagaggcgtataaaattcaaagttacgtcacaaaataatttgcgcaaatgcttgcaattgcaagcaaaagcgaacataataaagaaaagggaggcgatactatggcaaatacatccgctgtttatgcaagaatagatacgaatctcaaggacaatgctgagagtattctttctcagcttggcatttctccatccagtgcaattcagatgctttatagccagatcgtactgaaaaaaggtatgccgtttgaattgaaacttccttcttctaagccattagctgttggtgcaatgaccagagaagaacttgatgcagaactccagaagggtgttgattccatcaaagaaggaaaggtatattctgcagatgaagtcgacgcggtacttgcaaaggagtttggcatatgacggatagctataatgtcggctattctgtagatgcacttggtgatttacgtaaaatctattcgtatattgcgaatgaacttcttgttccggagacagccgcagctcagctggggcgcatacgaaaggaagttcgttcattggattttatgccagctcgttatacgttagttgaatgggagccttggcattcgatgaaaatgcatcagcttccggtagacaactttattgtgtattatcttgtcgatgataaagagaggacagttctgcttctgggcaagtagctcagtattgcctggatccagtttcaggagcttctcgacatccttgagctgactctgcgtattcttgatttctgaattgacaccctttaaggcactctgaagcttggtagtatcgccaccgatctcgaccgtgatacccttaattctacttcccgccataacgcacctcctccctgcaaaatgggcataaaaattgcccggcatttctgccgagcataaagaaagcaccgatcagatttctccgaccgatgctaataaattgctattctattgagatttacaaacaggaagttataaacatctttgcaaatataccatatctattaactgtacaccacactcataaattgggtggtcataattgtccgtaaagaaattcggaatattatgagaacggacaaatccgcattcttcataaaatggtacggtcaacgggctgtcacctgttccaacttgcaaaacagaatattcatctgcatatttactggcaagaaaatcaattagtgctttcccatagccctttccctgattttctggatcgactgcgatattcttgatttcaagtattgcgttaccttcatcggtgacaacacattcagcttttacattaccatcttcaagtacatacatattacctttttcaagatagcgatcaaccatgctctcctgttcatcagctaatagcaataatgatataaactgctttttattttcattcacttctctgattttcatatccattactccgtcaaactggaagtttcacctgtgttgttaaattggggtttactctttgaaatcactcttaagaactgcatactgcgcagtgtcaataaacgtgtcctttttgtaatacttttgtctagcaattccttcaaaccgcattccacactttgttaatacatgtacagatgcaacatttccatcaaacacttctgcctgaacacgatttaattcaatctcatcaaatgcatattttagtacagcttgaagcacttccgtcattataccttgtccccaatactgtggcgaaagcatatagcatgtatctgacataaaacatgattcttcaacatttcccaaattaatcgttccaatcaaatcatgattttctttccattcaattacccaatgaaaatatgtatcagattcataattatctgcccatttatgtaccttttctttatatatttccatatccgttacgggattgaacggaaagtacctgcaaacttcttcgtattttgcccagttttcatacatcatttgataatcgtctggaacaattcttctcaatatacaacgttctgtatctattatttttgtaccaattttattcattgcactcctccacaacttccgatttgtacttatttcttaaacagctcagaatgtggaccaaggcgataaagcatcaaaacaagaacatctccacaaatctcataaataagcagccagtccggttcgatgtgacactcacgcgtacctttgtagtttcctgtaaggtcatgatccctgtattttgcatccagcgtaccgccattcgccagaatatcgattacctcaaacagcttatcaagatctttattttgcttttttgcaagcttcaaatcctttttaaactgattggtaaactgaatgtcgtatttcatacgtcgagagctgccttaagcgcatccatactggaataacgcggagcagaaggatccttcatcatttttcggccttcctcaatggcagcggctgtagtatcatttggtacttccagttttaattcaaaaggaataccatgctcacggatagcggttctcaggaatatatttatagcagttgtcatattcagaccaagctcattgaagatttcctccgcctggtccttgattgccttgtctgtacgaatatttaaattagttgttgccatacagaacacctccattcaagtatagtatactcaaatgcacgtctaatgtcaacacactgtcattatataagatacatacctaaaatgaaaaagatgcaatttctgatttttatggtatattggaaataaaatgatgtgatcgtttatgcatacacaaaacagaaaggagtccgccatggatataacaggagtaggaaacctatcatatttatataattatggaatttcggacagcgataccagacatgtcacaggaaaagaaaacggcatcggaagcgtagatgaaaatgggaaacagaaggaatgccagacctgtaaaaaccgcaaatatgtcgacggatcagatgaagcaaatgtatcgtttaagagtgccgcgcatgtttccaaaaaagatttaaaggtaaccgatgggataaaggcgcgggaggatcatgtggatatgcaggtgtaggcgatgtatgtagtttacattgactaacgggtataacagctgttgccctgtatgcaccagtcaaagttgaaaattgcataaatggcagaaatatgttaccataaacatagactattgacagaaggtatatggagtggaagcgatggaaaaacaggaattttgcatggaaaaatctcagatatttcaggagatgatcagtcgtatttcaaaattatctcaggatagttatttaatggttactgatatgcagcataatttaacatttgttccagaaagtactgcagaatttctggggattccatcgggatggtgtgaagatggatataaaatagtgctggaaaagagcgtacacccatatgactgcccggaatatacggaagagatgaaaaaacgtctgcgggggatcaatctggagaacgatctgtacatccgtatgggaaaagacaaaaagtatgtgatgacgcagattataacggatatgattttagagcagggcaaaaacagatattttattgttctgcttcggaatcagaatgtgattccggaaattgatccgttgacggatctttatggtcaggtcaaatttgaaaaagatattgtggattatattcagcagggacgaaaagtagctgttttggaaattgaaattgatcatatgaatgatatcaatatattgtacggaacaaattacagcgaccggattcaaaaggttcttgcataccggtttatttacatgatggatgcagataaagcagtttatcgtatgggaaattccaattacgcatttattttgagggatgccagccgtgaagaggctgcggcatttctggagaagattcgcgcgcggctggaggaaagtgtcgtcttggaaaacaaccattttgacttgaagatatatgccagcgggataattcttgatcattatgagggagaaatttccacggtacagagtaagctggaatatgttttaggaaaaatgcgtaccagacgggatcataagttaatgttctttaatgatctggtacagatcaatggggacgtggatctggatctgatgaagataattcatcagtctgtgctgaaccaatgtgacggattttatgtggagtatcagcctgtcgtacatgcacagacaggagagattgccggagcggaagcactggtccgctggaaaaaagagccatatggtattgtgccaccgggaatgtttattgactggctggaaagcaatccatgtatgtatgatctgggaaattttgttttgaaacaggcattgacggatgctgtggagtttcgaaaatcaaatccggatttttttattaatgtcaatatgtccgcaaaacagctggaaaggaaaacgttctgtggtgttgtcatggcattgttgaaagaaaccggttttccggcggggcagttgtgtctggaactgacagagcggtgtagaagcatgccggtcagcgttatggaagaaaaactgttgtacctcaaacaacatggagtgagacttgcaatggatgattacggtacgggaagtgcttcttcaagtgtcctgctgcagaccccgatggatgagataaagattgacatgagttttatccgtggaattacggataatcagaccaaacaggcactggtgcgcagcatggttgattttgcaaataaagcggatttaaagagctgcctggaaggggtagaggatgaaaagctgcagaattatctgcgttcctttggagccacatggtttcaggggtattattattccagaccggttcaggcagctgcaatgcaaaaattgttaaacatggaaaattgataattagtcggtgatgagcagatcaacgccggctttttcatagatttcttttgtattttcggataatccggagtcggtgattaccagattcagatcatcaatagaggcatagctggagatggatgaggtgtcaaatttggtgtggtcaatcaatgcaattgttttagcagaagccttgatacacatgcgttttaaatctgcttcgtagatactgaaatcggtaagtccgttttcaacggagaagccgcgtgcagagacaaatgcaatgtccgtatgaattttctgtagcagatccacaccgaggagaccttcaatggaagaagaggcagaggtaacgattccaccggtcaggataacggtgatcccggggatatccttcagagccagtgcaaggtcaatgccgtttgtgataacggtaagttctgtaaagccggtcagtttcatgccaagtgtataggcagtggagctggcatccaaaaagatgcacatgtgatcttttaccatgtggatggcatttgcagcaattgcctctttttcttttttattttccagtgcacgttcatgaaagaaataggcttttccggtaagttctttattgtctgcagagttatcgtggtagagtgcgcctccatgtgttttggtcagaagtttttctttatccatctggtttaaatcggtacggatggttgtggtggaaactccaagcatttcactgagttcatttgtggttgcttttcggttttgtttcaaatattccaatataagtttctgacgttctaattgcagcatgatgattttttatactcctttatatttacgaaaacacagatttcgaaagtttatatataggatactatacatcggaattgcattttttgccagtgaaaagtgaaaacaaaaaaaatggcaaagacgtggatgaaaatcagcagctgtggtatgataagaaaaaagcataaggaggggtttttatgctaaaagagtgggaaaaatccgaaaaaccatcggaggaggaaattaaggcacggctggaagcggtaaaagagaaactggcacggcagcagcttttgatcaaagagaagaaagtaccggttcttgttgtgcttgaaggctggggaacggccggaaaaggttatgcaatcggccagatcatccagaatattgatccgcgtttctttaaggtggtgtcgatgcagaaaaagacggaggatgacaagagaaaaccgtttttgtaccggcattttgccaaaattccggaagccggacagtttgtatttctggatacggcatggatggatgagattacggaggagcgtctgcacggaaccatttccgaggatgtatatgccaaccggattgaaagtgtccgccggtttgaacggcagcttacagacaatggctatctggtcatgaaattctttctgcatatttcaaaaaaggaacagtcacggcgtattgcacagctggagcatcagaaggacacaacatggcgtgtcagcaaaaaagatctgtggcagaatgaacattatgagaaatgtatggatgtattttccggatatctgaaaaatacaaatatgccatccgcaccctggtatatcattgatgcaaagtccagaaaatggacagaagtacagattcttgagacgcttacccaggggattgagattgctctgagcaatcaccagatggcggttccgcttctgcagaatgtatttccattgaaaaaaatgccgcttctttgtgacattccgttggacaagtgtatggaggaggatgtctataaaaaggaattaaagcagcttcagcagagacttggagaactgcacaatcgtctgtatcgtaagaaagtgccggtcatcattgcctatgaagggtgggatgcagccggaaaaggcggaaatatcaagcggattacgggagcacttgatccgcgtggatatgaggttcatccgattgcaagtcccgagccgcatgagaaagcaagacattatctgtggcgtttctggacaaggcttccgcgtaccgggcatattgcaatctttgaccgaacgtggtatgggcgtgtgatggtcgaacgtctggaagggttttgcagcgagaatgactggatgcgtgcgtacaatgaaattaatgagtttgagaaggaactgcacgactggggagccgtgatcatcaaattctgggtgcagatcgacaaagatacgcagcttgcccgttttaccgatcggcagaacacgcccgaaaagcaatggaagattacagaggaagactggcgcaaccgtgataagtgggatgcgtatgagggggcagtcaatgagatgattcaaaagacgagcactacctatgcaccgtggcatatcttagaatccgtagataaaaaatatgcacggattaaagcattaaggatcgtgattgctgaactggaaaaagtgttagactgactggaaaaataaaaaaggaataccccggcaaacggaatttccgttgccggggtatttttgcgacttatgatgaaacatcgcagaattatgaatttgcttttttcaggtttttctgtgctgtagaaagcatcagcttgatacggttgagctggttaacttctgatgcacccggatcataatcgattgcaacgatatttgcgcctggatattcgtgacgaatttccttaatgacacctttaccgacgatatggtttggcaggcaggcaaatggctgcgcacagacgatgttggttgctccctgtgcaatcagttcaagcatttctccagttaagaaccagccttcgccggtctggttaccgcaggagacgatatgctctgcctgttttgccagatcctgaatatatgcagttggctcaaaatgtttactctttgcaagttcatcccttgcatccttgcgcagccactcaaagaagcggatgagcatattgttgatgcgcttggattttgcggtagctccaagataatccgccttgaaattctgattgtagcagcagtacagtaagaaatcggtcagatccggtacgactgcctccgcaccttcggattcgagcaggtctacaatatagttgttggcagccggaaggaacttgacaaggatctctccaaccacaccgacacgcggctttttctcatccgtcattggcagattgtcaaagtcgcggatgatctgacggcacattttgcgatatttacggtgggacagaatcttggtgttgccaacaaagtcaatgacacgttttttccatttttcgtgtaatgcgttggcagatcccggtaccttttcgtatgggcgcacacggtagagacagcgcatgaagatgtctccgaattccagagcgtacagaccatgctggatcaggcttggtgtgagtttaaatcccggatttttctccagaccgaccatgttgatggagatgaccggaatatccgggtggccggctttggtcagtgcacggcggataaatccaatgtagttggtcgcacgacagccaccaccggtctgtgagatcaggattgctgttttgctcaggtcatatttgccggacattaccgcactcataatctgtccgatgacaatcagggacggataacatgcatcgttatttacatactttaaaccgacatcgacacattctctggacggaacatctgggatgaccagattgtagcctgcggcacggaatgccggaacgagaagttcaaaatggatcggtgacatctgtggacagatgatagtgtaatctttacgcatttcctcagtaaagataacgcgctcgtaatttgccggcttgatttcgcgtttttcatgttttttctctttgacacgaattgcagccagaagcgaacggatacggatacgggcagcaccgaggttgttgacttcgtcaatctttaagcatgtataaatttttccggaattggtcagaatatcgctgacacagtcggttgttacggcatccagtccgcagccgaaggagttcagctggatgaggtccagatcatccctggtcttaacgtagtttgcggcggagtacagccggctgtggtacatccactgatccatgacaataagcgggcgttccagattccccagatgggaaatggaatcttctgtcagtacacacataccgtaggaagtaatcatttccggaataccgtgattgatttccggatcaacatggtatggacgaccggccagcacgataccgcggcgatggtgttcttccatatatttcaatacttcttcgcccttcttctgcatctccagacgggtcatggcaagttctttccagccttcggatacggcatcacgtacttcggcttccggaatattgaattctttcttaaaacagtctacgagctgtttggaaaggacttcttcgtttgtaaacgccatgaacgggtttaagaaccgcatctgtccactcgtaatttcctcaacattgtttttaatgttttcggaataagaagttacgatcgggcagttgtagtggttgtttgcatccggaaactcgttgcgctcgtaaggaatcgccggatagaaaataaaatctacattctggtggatcagccaggaaatatgaccgtgcgccagtttcgccgggtagcattcggattcgcttggaatagaatcaatgccgagttcgtagatttttcgtgtggactgcggagagagaaccacacggaaaccgagcttcttaaagaacgttgcccagaacggatagttttcatacatgttcagtacacgcggaagtccgacggtcccgcgggttgcttcggcttctgacagaggttcataagcaaaaatacgtttgttcttatattcgaagaggtttggaatattctctttgtttttttcttttccaagtccgcgctcacagcggtttccggtaatatactgacggttgtctgaaaacttattgatcgtcagcagacagtggtttgtacatccctggcagcgtgcaagcttggtagtgtaggacagtttattgatctgttcaatggacagcatcgtcgtctgatagccggcttcgtgacgttcgcgggcaatcagtgcggcaccgaaagcacccatgattccggcaatgtccggacgggttgcgtggacaccggcaattttttcaaaactgcgcagaacggcgtcattgtagaaagtaccaccctgaacaacaatattttctcccagatctttggcatcggacagtttgatcaccttaaataatgcgtttttgattacagagtaggcaagtccggcagagatatcggcaacggaggcgccttccttttgtgcctgttttacctttgagttcataaatacggtacagcgggtaccaagatcaatcggatgtttggcaaacagtgcttctttggcgaaatcctgcaccgtgaagtttaaggattttgcaaaagtttcaatgaaagaaccgcagccggaagaacatgcttcgtttaactgaaccgaatctacggtctggttcttgatcttgatgcatttcatgtcctgaccgccgatgtctaaaatacagtcaacttttggatcaaagaaagcggcggcatagtaatgggcgacggtttctacctcgccgtcatcaagcatcaatgcagctttcaaaagagcttccccgtatccggtggagcaggagtgtacaatgtgcgcactctccggaagcagacggtaaatttcctgaatggaacggatggcagttgcaagcgggcttccgttattgttgtcatagaatgaatacagaagttttccgtcctcgctgacaagtgcgatctttgttgtcgtggaacctgcgtcaataccgagatagcagtttccggaatagtttttcaggtcaccggtttctacatgattgtttccgtgccggctggtaaaagcatcgtaatcttcctggctggcaaacagcgggtccagacgggcaacttcaaactccagcttaatgccggtggaaagacgctgctgcagagatcctaaagtggtctctacgtctttcttataatttaatgcggaaccgatcgctgcaaacagatgcgaattttccggtgtaattgcgtgctcatcatcgagatttaacgtgcggataaacgctgctttcagttcggataaaaaatgcagaggaccaccgagaaatgccacatgtccgcggatcggtttaccacaggcaagtccactgatcgtctgattgacaaccgcctggaaaatagaggcagacagatcttcgcgagttgcaccctcattgatgagcggctggatatctgtcttggcaaatacaccacagcgcgctgcaatcggatagattgctttataatttttggcatattcatttaatccggaagcatcggtctggatcagggatgccatctgatcaatgaacgaacctgtaccgccggcacagataccgttcatacgctgttcgacattaccgccttcaaaatagatgatcttggcatcttctccgccgagctcgattgcaacatcggtctgtggcgcataatgagtgagagcagtggatactgcaataacctcctgcgtaaacggaacctccagatgctttgcaagggtcagtccgcctgatccggtaataacaggagaaacagaaagatcccccagttcgttggatgctttggcaattaaggacgccagtgtctcctgaatatttgcaaaatgacgctcgtaatcggaaaacaggatgttgtcctgtgagtcgaggattgcaattttgacggtggtggaaccaatatcaattccaagtttatgtaactgcttgtcactcataaatgtaacctccatgtgtaagtaactaaacttattataaataagtatgatttcaaaacaaaacctaaaacattatacgacaagaattgacaaaagacaacgactgaaaacataaagattttataaaatgttggaaagaacgtgccgctgcgttgacaagagggatttgaaaaccgtataattggttgacagaaaggtcagaagtgaccgtaaccatacatacactattctatgtagacaggagacagatttatgaactggatggataaactggaacgcaaatggggacgacatgcggtcgccaatctgagcagatattttgtacttgcgcaggtgattggatacgtggtacagctgacggcacccggactcatgagttatatgaattttgatatgggcagtattctgcacggacagatctggagagttgtgacatggatttttacaccgacggcatcgctggatgtttttggaatcttatttctgttctgtgtgcttatgtggggcagttcgctggaatccatgcttggaacattccgcatgaatgtatttttgtggggaagtgtgattttgtgtgacattgtgggtgcgatcgtatatgttgttacgcggattctgctgggatatggtttttctccgtatctgtccacgtattatattctgatgtccatgctgctggcgctggccatgtgcatgccggagggagaggtacgcctgtattttgtccttccgatcaggatgaaatggatgttaatttttgaacttgtatatctgggatatcaggtggttcgtatattctcgatcggaattgcaagttatggaaccggaatgggaattctcgtgggtgttttaaactgcgtacagattgtggttccggtactcaatatgttctggtttttccatgcaatgaagacccgtttgtccggaaaacaaaagaaacgccagaaagaattccgggcacagttcagtcagcctcgtccggggtccggcattgcacgtcacaaatgtgccatctgtggtagaaccgagctgacaaatccggaattacagttccgttattgcagcaaatgcgtgggaaatcgtgaatactgtcaggatcatctgtttacccaccagcacgtaaaataaaatttagtgagtggaaaagaaaaaaatcatgaagaaaaagtttttaagtgttttgcttatcgttgcggttctgataggaatggcaggtgtcagcggaacacagacagaatcaggagaacagaaagcagacaaagaacaaaagcagcaggaaaacgaacagactgcggaaacgaaagtggaaattccaccggaaaatgaggaagaacaaaagggatggatcggtgttatcttaaacggagatgagacagaagcctatacactggcacatattgacggaatccgggcggcagcagaaaatgtcagtcttccggagcaggatatcatctggaaagagcgtgtcggtgcgaatgatggctgcaaaagtgcggtaaaggatcttatcagacagggatgtgagattattattgcaaacagcgccatctatgaagaagcaataaaaagtgaagcagaaaagaatccggaagttgattttgtagttatcaacgattcaaagacacagagtacggtaacggaagacggaacagaactcacaaatctttacaatgtacatatggatacctacgaagcttcttatgtggcaggagtcacggccggaatgaaagtagcaaagctgaaggaaaagaaaaagattcccgcaaagagttttgacgaaaagaaaaatgtaaaactgggatatgtggcggcagaggcaaacgatgatgcacatgcagatattaatgcctattacctgggagtaaaggccgtctgtaaaaaggttgttttacaggtagaatacatagatgcctggaataacagtgatgcggaggcaaccgcggccggagatctgatccggagcgggtgtgtggttcttgcatccaataccgatctggatgctgttatgcagatggctgaaaatgcaaaagaaagcggaaaatgcgtatacgcggttggaagaaactctgatatgcgtcagatggcaggaaaggccgcgctgacttcggttgtcagtgtgtggtcggtttattatacagagctgtttgatgcaaagctgaatggccgctatatggaacagaactggaatggcggatatgcacagggagcggttacaatttctacactgggaaaaagtgcatcatccggaaccggtgacagagtgaaaaaaacggaagaaaaaataaaaaacgggaagaaacagattgcatatttttcaacacgtgcgctggacggaattctggaatccgaaaaaggacaggagcaatagcgtacacaggcgcgttccggttgacaaatatcgggaatatccttataattattcttatttgaggagtgctggaggaatagacatatggaaaatgaagcggtttccaagaattttattgaacagattattgaaaaggatctggcagagggacattgtgagacggtaaaaacccgttttccaccggagccaaacggatatctgcatatcggacatgcaaagtccattcttttaaattcagggttagcaaaaaagtacggaggagaattcaatctccgttttgatgatacaaatccgacaaaagagaaacttgagtttgtagagtctattaaggaagacgtaaaatggcttggagcagattggggagatcgcctcttctttgcatcaaattactttgatcagatgtatgaagcagcgattaaactgattaaaaagggaaaagcatatgtatccgatctgtctgcagacgaaatccgtgagtatcgcggtactctgacagagccgggaaaagaagacccatatgccaaaagaagcgtagaggaaaatcttgcgctgtttgaagaaatgaaggaaggaaaatgtgaggatggaagtcgtgtacttcgtgcacggattgatatgacttcttccaatatcaatatgagagatccgatcctttatcgtgtggcgcatatgacacatcacaataccggggacaagtggtgcatttatccgatgtacgattttgcacatccgattgaggatgcaatcgagggaataacccattccatctgtactctggagttcgaggatcacagaccgttgtatgactgggttgtgacagaacttggatataagaccagtccggaagggactccgaagcagatcgagtttgcaaaactgtatctgacaaatgttgtaaccggaaaacgttatatcaagcgtctggttgaggagaagattgtagatggatgggatgatccacgtctggtttccattgcagcgctgcgccgcagaggatatacaccggaatccattcagaaatttatcgaacttggaggtatttccaaggcaaacagttctacggattatgcaatgcttgagtactgcatccgtgaggatctgaagatgaagcgtccacgtatgatggcagttttagatccggtaaaggttgtcattgacaattatccggagggtcagacggaggaacttccggtggacaataatctggaaaatccggaactaggaaagagaaccgttccgtttaccagggaaatttatattgaacgggatgattttatggaagaaccgccgaagaaatatttccgtatgttcccgggaaatgaagtgcgtctcatgaatgcatatttcgtgaaatgtgtcggatttgaaaaggatgagagcggaaaagttacggttatccactgcacatatgacccggcatcaaaaggcggaaacagcccggatggaagaaaagtaaagggaaccattcactgggtatcggcagaacacggaaagaaagtaacggttcgcttatatgagaacctcattaatgaagaacttggtgtatataatgaagacggaagtctgaatctgaatccgaattccctgactgtcctgacagagagcattgtagagccggcattgttagaggcaaaaccatatgagagttttcagtttgtaagagaaggatttttctgcgcagattataaggattcaaagccgggagcgcctgtatttaacagaattgtttctttgaagagttcttttaagctgccgaaaaaataaagaatagacaaaaagaggcgtagaatgaatttattatcgggattggaaaaatttggtctggatcagatggatacagaccacctctttgaagaggaaaaaagtgatacacctgcacggaaagcaccggaaccggtgccaaaaaaagaaccggttcacagcgaaactgagttcttactggataaatccatccgttgtccggtatgtgataatgttttccgtacaagaatggtaaaaactggacgggtaaagcgcatggaaccggattttgatctacgtccgcgttttcagtacattgatacaaataaatatgatgtatcgtcctgcccacagtgcggatatacggcgatgaaccgctattttacccatttgtctaccggtcaggtcaagatgattgaagaaggggtatgtcataagttcaaagggcagaagcagccaaaagaagaaccgatggagccgtattcttacgaaaaagccattgagcggtataaactggctttatataatacactggtgaaaaagggaaagaacagtgaaaaggcatatgagtgcctaaagatatcctggctgtaccgcggctggattgaggagctttccaaggcagagaagaaagatgaaaaaacacttgccgaatgccggaaagaagaagccacgtattatgaacaggcatatgagggatttttaaaagcgattgcatccgaaaatttcccaatgtgcggaatggaagaaagtaccgtaaacctgttgatggcgaatatggcttataaacttggaaaggtggacattgcatccagattcatttccatgattctgacttcacaggcagcttcccgtgtggcaaaagaccgagcgatgcttttaaaagaagagattattgcaaaactgcacggcaaaggataatctatggctggaaaattttatgcggtaaaaaagggaaaagttccgggaatttatacctcatgggatgcatgtaaaagtatggtgcatggatttccgggagctgtctataaagggtttgcgacacgcgcagaagcggaacagtttctggaagaaaaaaaagaggaacaaaaggaaccggaaaattatgcgtttgtcgacggttcgtttaacagtgctacttccgtctatggatatggcggatttctcgtgacaaagggagaacgttacgtgatcagcggaagcggcaatgatccacagatggcatcgatgcgcaatgtggcaggagaggtgttaggcagcatggctgcagtaaaagaagctgttgccatgggacttaccgacttaaccatttattatgactatatgggaatcgagatgtgggcaaccggagcctggaagcggaacaaacagggaacgattgcctattatgattttatacagtccgtgaatgataaaatttcccttcattttgtgaaagtgaaaggacattccggggtagaaggaaatgaagaggcagaccggttggcaagacttgctgccggggtagattagacagacaggggtgacaaagtgagcgtatttaatgtagaactgaaaaaagtggtggatgacagttacgatattgagatggggtaccatctggaggatcagctggtagaggatttagagaccggtcttctgggaaaaatcaggaagtttgccgtgatcacggattccaatgtgctggatctgtatgcaaaaccaatcagtgaaaagctgagcaaggctggatttaaagtggaactgttcgtatttcccgcaggagaaaaaagtaagaccagacagacgaaggcgaagattgaagatgccatgctgggaaaagggttccgcagagattgtgctgtgattgcaatcggcggaggtgttgttacggatctggcaggatttctggcaggaacatatggcagaggcataccgtttatcaattatgcgaccacacttctggctgctgcagatgcatccgtgggcggaaagactgccgttgatacaccgcttgcaacgaatctgattggacttttcaatcagccgcgcaaggtctacattgatattgccgcatggaaaacccttccgaaacgtcagatggcaagcggcatggcagagaccatcaagcatgcatgtctggcgagccgtgaaatgtttgagtttatcgaggaaaacttggatgatattatgagtttccagaagtttgcctgcgaatatatcgcagagaacaactgtaagatcaagtatgatgttgttatgaaagacgagagagaaagcggactgcgcgaagtcctgaatttaggacacacggtgggacgcgccattgaaactgtcagtgactaccggctcctgcacggcgaggcactttccatcggaatggcggctatggtactgctttcggcacgccttggctatatgtcagaggaagaggaagagcgtgtgactaagctgtatgagcgtgtgggacttccgacaaagattccggattatattgatcgtgaggctctggttaagaagctttataccgacaaaaaggtgcgtgacggaaagttacgctttgtgattgaaaaaggtattggcgatgtagtggagtttgcaccgaatgtgtatgccaagccgatcgaggagagtctggcaagagagattattatggaactgtaaaagttatacgaggacgatgggctgtcggtattcgtttggtaattcggtctgtatctgcatggaagatgtagtgcggtacagatcagcacaggctacatcgtgtaaaaaacgtttgtatgcaattccatgaaggatagaagaagcatctgcaactttggtaatcaaaggaacggatgcttcttttttgatggaggaaagaagcgcagaggaattcctgcgaaaaccaagtacccgcagatacggaatgccatccggctgccagagcgcagcataatcgtcctgccggatgttaagcaggatgtgaagcagagcgcggcagatgcgtgtgtaagttgtatttttgcttttcagcagatcggcaaactgtgaaaagcttaaaaaatgttcaagctgctgtgtgatccggtgggacagatccttgccacagtctgcaaagccagcatagcctccgtcgtacagtgcccataaccgggtgtagagagcctgagaaaaagcatccgtgtccagaagaaggttctgttgcgccaaagtggcaaggagggaggcggaagtctcgggaagcatctgcgaaagcctgaaatcatagccgtctgtacttatacgcatagaatggttgtggttaccgtcattttcagacggcgcgagcagggtgtttcttatggcggttgcagaggcgtaggttacgcctgtttttgtgctgtgatagccttccccgatacgctggacaggcatactggaaagatcatggtcatgtacgctgtttatggaattccagcgggcgattgctttttcgtattctaaggccagaatattgttcggagatgccagaaaagaagaaaccgcatcagaagaaaaggaaggcagcagggaacacagtgcgtggcttcgtgcgacaggaaacggatttccctgcttcatgtcataagaaaccagcatctgatagtccgaagcatttttggaaagaacttcgacaattgcctgcataagttctttttccggagtttcacagccatagcagagcgtgtcaacgacgcctgtttttccgagaagctgtacgcctccggcagcaaaatattccgcggaagcggtcgcccatacagccggaagttcgagtaccagatcggcaccgccgagaagtgccatgcgggtgcgcgtgtatttgtcggcaatggcaggaacaccgcgctgtaagaaatctccgctcatggcaacgatcacaaaatctgctcctgtaaggtggcgtacggtttccatctgatattggtgtccgttgtgaaacggattgtattcggcgataattcctgctgttttcacgtttgcctcctgttcggtcgtttcttctgcctgtttttctgttaaaatattaacacagcttttcgaggatttccacttgtataagaaggaaaatgtgtttataatggaaaaagattgtggatttccacaaaatgaataaggacaagggagaattcaaatgaacgtattagtaatcaactgcggaagctcttccctgaagtaccagctgatcaactctgattcagaagaggtacttgccaagggcttatgcgaaagaatcggaattgacggaagactggtttaccagaaagagggaatggataaggagatcacggaagctcctatgccaacccacaaagaggccattcagatggttcttgatgcactgcataatccaaagagtggagcagtaaaggatctgagcgaaatcgacgcagttggacatcgtgttgtacacggtggagagaagtttgcaaagtcggtggtactgacagaagaagtgcttgcaaaggtagaagagtgtaatgaacttgcaccgttacataacccggcaaacctgatcggtatccgtgcgtgtcaggatcttatgccaaatgtaccgatggttggtgtatttgatacagcgttccatcagacaatgccaagaaaggcattcctgtacggacttccatatgaatattatgagaaatataaagtaagaagatacggattccacggaaccagccacagttttgtatccaaagcatgtgcagagtatctgaaactggatctgaaaaacagcaagattattgtagcgcatcttggaaacggagcatctgtcagtgctgtattaaatggagaatgtgtggatacttctatgggtctgactccactggagggactggttatgggaacccgttccggagatattgatccggcaatcatggaatttatcgcaaagaaagagaacctcgacatcgatggtgtcatgaatgtgttaaataaaaaatccggtgttgaaggattatccggtgtatccagtgatttccgtgatctggaagctgcttataatgaaggaaatccacgcgccattgatgcctgtgaggtatttgcttaccgtgtggcaaaatacatcggtgcatatgttgcagcaatgaatggtgtggatgcgatcgcatttactgcaggtatcggagagaatacttctttcattcgtgaaaagatcgtttcttatctgggatatctgggaatcaagcttgataagaagacaaacgatgtgcgtggcgtggaggaaattatttccacaccggattcaaaagttaccgtatgtgtcattccgaccaacgaggagcttgcaatctgtcgtgagaccgtagcactggtaaaataaatgttgataaatttgttgataatttgtaaaaattagttgacaaagcaggacaccctatgtataattgtttaggtgtgaataggagaatactgtgaaaattgatctttcaatcattacaaaatccataaacaaggaattgacacaggaggcggacatctcgctcacttcctttcgtttccgcttgggagattttcctattgttcgcaaagcgccggtgacattgcagatccgtaatgaggagaatgcagcggtattcgttaagggtacggttgatattgatgtgatgattccgtgtgcgcggtgtcttgaagaagttcggacgccgatccgttttgacatagataagaaactcactgttcgggaagagggacttgtcgatgaagagatggaggaaccggattacctgattgggtttgaactggatgtagataaacttgtctacgccgagattttggtgaactggccaatgagagttctgtgcaaggacgattgcaaaggaatttgtaaagtctgcgggatgaacttgaataagggagcctgcagttgccagagaacagagcttgatccaagaatggcagcaatccaagatatatttaacaggtttaaggaggtgtaaacaaatgtcaatttgtccaaagaataaatcttctaagggaagaagagataagagaagagcaaactggaaaatgtctgctccgaccttagtaaagtgcagcaagtgcggcgaattaatgatgccacaccgtgtatgcaagaactgcggatcttataacaaaaaagagattatcgcgcaggattaataaggataggtctttaaaaatcaagagttggcggttttgctgactcttgatttttttgtgtctgaaagagccaatttatcgttgatttatggaatgatatatagtatattttctagtagatgcataaggaggaacagaccatgcagacaatcacgaaagtagctcttgatgcaatgggcggtgataatgcaccggcagaaattgttaagggagcagttgatgcggtctcttcccgtgaagatatcaaagtttttctggttggacaggaagatgtggtaagggaagaattgcagaagtatccatatccgcaggagcgtattgaggttgtggatgcgcctgaagtaattgagatggcagagccacccgttcaggcaattcgaaagaaaaaacagtcatccctcgttgtaggtatgaatatggtaaaacaaagagaagcggatgcatttgtttccgcaggaagttccggagcggttctggttggcggacagacgattgtcggacgcatccgtggaatcaaacgcccaccgctggcaccgatcattccgacagagaccggaatttcactgttgatcgactgtggcgcaaatgtagacgcacggccggaacatttattacagtttgcaaagatgggttccatttatatggaaaacgttgtggggatcaagaatccgagagtggcgattgtaaatatcggtgcggaagaggagaagggaaatgccctggtaaaagaaacatttccgctgttgaaagaatgtgaggatatcaattttgtcggaagtattgaggcaagagagattccacacggtggagcagatgtcattgtgtgcgaggcatttgtcggaaatgtcattttaaaattatacgaaggtctcagttcaacattgatcggtgtgatcaaggcgggactgatgagcaatttaaagagcaagatcggtgcggcactggcattgccgtcactgaagaagacactcaaagcatttgatgcgagccagtatggcggagcaccgcttctgggattgaatggtcttgtggtaaagacccatggaagttccaaggcaaaggaaattaccaattccatttaccagtgtgtgacattccgtgaagagaatattaacgaaattatcaaagaaagaattgtagattccaaaaataatgaagaagaataagaaaggaaatgaagtattatggaattcgaaaaattaaagaagattattgtggacgtattaaacgtggacgaaaatgagattacgatggataccacattcattgatgatctgggagcggattccctggatgtattccagatcattatgggacttgaggaagaatttgatattgagattccaaacgagcaggcagaaaagattgttacagtaggggatgcggtagaacagatcaaagctgcaatgaatgaaaactaaacacagatacgaaaggagtccggtggcggactcctttatttcagaaaggggaaagaagtgacagatattaaaaaatttcaggaagtgatcggatatcactttcatgatgaaaaactgcttcgtcaggcactgacgcatagttcatttgccaatgagaagcacttaaagaaacattcggacaatgagagactggagtttttgggcgatgctgtgcttgagattatctccagtgaatttttgtacaaagagtatccggacaagccggaaggagaactgacaaaactgcgtgcaagcattgtctgtgaaccgacactggcactctgtaccaaggatattgctttaggagagtatcttttactcggaaaaggagaggaccagaccggaggaagaggccgcaaatctattttgtctgatgcgcttgaagctgtgatcggggcaatttatttggatggtggttttgctaatgcaaaagagtttattcataaatatattctgacagatattgaacacaaacagctcttttatgatagcaagactatcctgcaggaggttgtgcagggagaacatgagcagcttacttatgtactgaccgatgagtccggtccggatcataataagagttttactgtccgtgcatgtattggagagcgtgtcattggcagcggaaccggacataccaaaaaagcggcggaacaggaggctgcatatcaggcacttctgatgcttaaaaatcagcaaaggggatagtacatgtatttaaaaagtattgaggtgcagggatttaaatcatttgcaaacaaaattgtatttgaattccaccagggaatcacgggcattgtaggaccgaacggaagtggaaaaagtaacgttgcggatgcggtgcgctgggtacttggagagcagtcggtcaagcagctgcgtgggtcttccatgcaggatgttatttttgcgggtacggagaaccggaaaccgctcagctatgcgtatgtagcgattacactggataattccgaccataaactggcaatcgactatgaggaagtcaccgttgccagacgtctgtatcgttccggagagagtgaatatctgatcaatggcagtccgtgccgactgaaagaagtttcagaattgttttatgataccggtatcggaaaagaaggatattcgatcattggacagggacagattgaccggatcttaagcggcaaaccggaagaacggcgcgaactttttgatgaggcggcaggaatagtaaaattcaaaaaacgaaaagcgactgcacaaaaaaagttagagaatgagagagacaatctggtccgtgtaaacgatattttgtcggaactggaacgccaggtggaaccgttacagctgcagtcggaaaaggcaaaaacctatttaaaaaagaagaatgagctgaaagattatgatgtcaacatgtttctcatggaaacagagagaatcgcatccgagcagcgtgaagtagaggaaaaattcaaaattgcagaggaacagctgaaagaaagcacggatgcaagggaaaagatccgccaggaatatgaccgtttgggcgaaagcatcacggaaatggacgaaaagatcaatgcaatccgggaaaatattagcaatacgtctgtgatgaaggaaaaactcgaaagccagatccagatactggcagagcagatccatacggcagagatgacagatgaacatctgcagagccgtctggatgccattgcgcgggaacagaaggaaaaggaggaggcaaaagcttcctacgagaaagaaaaatattccggtgatgaacagcttgcacaggtacggaaacgacaggaagaagcagcacagacactggcagagatacagaaacagattgcatcttgtaatgagggaatggaacaggggcagaaagaattgtttgcgctgttaaaccgcagagcagatattcaggccaaacagcagcgttccgataccatggtggagcagatcaatatacgaaaagcagagcttggaaagcgtctgctggacagaaaaacgcaggaaacggatctggattcggttcttgcagactgtaaaaaagatctcgaagaggtcagtgcgcatatccgaaaactttcggagcaggaaaaagaattaagtgcaaaggaaaaagaatggagaactaaggcaaaagaaaatgaccgtgcattagaagaaaagcaaaacgaatttcacaggcagcagtctcgtctggagtcgcttaaaaatattgcggagcgctatgacggatacggaaacagtatccgcaaagtgatggaacagaaagaacataatccgggattactcggggttgtgtcagatctgattcaggtggataagaaatatgagattgcgattgagaccgctctgggtggaaacattcagaatattgtgacggaagatgaagcaacggcaaagaaaatgattgcatttctgaagcagaaccgtttcggacgtgcaacatttcttccgctgaccagtgtaagcgcaagaaaaaatccgaagaatgaagcggcactgaaggagcccggagttattggaattgccagtcagctggtaaagtgtgagcaaaagtatgaggaagtggcggcgtatctgctggggcgtgtgcttgtggcagattcgattgatcatgcgattgcacttgcaaagaagaatcattacagtttacatattgtaactcttgagggagaatatttaagccccggtggttccatgacgggtggagcatttaaaaattcatccaatctgctggcaagacgccgcgaagtggaggaactggaaacgaaaacgaatcgtctgcttcaggagattgcgcagataaaaaaccgcagggaggatcttcttacggccattgagctgaatgaggaagacctcgaacaggtgaaagaaaccctgcagaaagaatttattcgtcagaatactgcaaagatcaatgtggatcgcgcaatgcagcagaaaaatgagagtgaagaagtattttcaagtctcatgaaggaacggcagcagatggatcggcaggtagaagaaatccgtgcagatcagacaggcattaaggaggaactggaacattccagacaacaggaaacggaaatccagcatgcgaatgaagcgtttcagaagatgcttgaagaacagaaagaactggaaaataaagcggaatcggaactttccggaattcagcttgaggaagcgaatatccggcagaaagtagaatttgcccagacaaacgtggaacgtatcaatggagatctggaaaaattcgagacggaaaagactgggcttctggagaatgcgaaaaattccaaagaagatgtggaaaagaaacagcacgacattgcagaaatccaaaagacgatccttgcttcttcggattcccatgggcaactggaacagaaacttcgtgaaagcgtagaacaaaaagaacagatgtctgcggaataccggggatttttccggaaacaggaggaaatttccgagcggtgtaacggattggataaagaagtgttccgtctgaacaaccagcgggaaaagctgaatgaatctgcagaacaacagacaaattatctgtgggaagaatatgaactgacaccgcatgcggcagcagaattaagaaacagtgaatacgaagatccgcttgctttaaagaaactgatcgcagcagtaaaggatgagatccggaagctgggaacagtcaacgtcaatgccattgaagagtacaaagaagtttcggaacgttatacgttcctgaaagggcagcatgatgatctggttgaggcagagcagacactgctcggcatcatagaagatctcgacagcggcatgagaaaacagtttatggaaaagtttgcggaaatccagaaagaatttaatgcatcattcaagcacctgttcggcggcggacatggagctttggaactggtggaggatgaggatattctcgaatgtggcatccgcatcattgcgcagccgccgggaaagaaactgcagaatatgatgcagatgtccggtggtgagaaagcgctgacagcaattgcactgttgtttgcgattcaggcgctgaaaccttcgccgttttgtcttctggatgagatcgaagcagcgcttgatgattccaacgtctcaaggtttgcaagttacttaaataagctgacaaaaaacacacagtttattgtaattacgcacagacgtggtacaatgacagcagcggaccggttgtatggaattaccatgcaggaaaaaggtgtatcgacacttgtgtcggtagatctgattgaacatgatttgaactgattgattatgtaaaaagaaagaagcgataagaaaggaaactgatatgggagaaaagaaaggttttttcagccggcttgtcgaaggactgaccaagacaagaaataatattgtatccggaattgattcggtatttcacggtttttctaaaattgatgatgagttttacgaggaactggaagaaattctgattatgggtgatctgggcgttaaggctaccgagtcgattctggatgatctgcgtgaaaaagtaaaggcaaaccatgtgaaagagcctgcagaatgcaaacagcttctgatcgacagcatcaaacagcagatgcaggtcggtgagacggcataccgctttgaagaagagacatccgttgtccttgtgatcggagtcaatggtgtgggaaagaccacaaccgtcggaaaacttgcaggtaaactgaaagagcagggaaaaaaggttatgattgccggtgcggatactttccgtgcagcagcaggagatcagctcaaagagtgggcggaccgttcgggagttgacatgattggcggaacggaaggcgcagatccgggatctgtggtttatgatgcaacggctgcagcaaaggccagaaatgcagatgtgcttctggtcgatacggcaggacgtctgcacaacaagaaaaatctgatgaatgagcttggaaaaattaacaagattctcgaaaaagagtatccacaggcgtatcgggagacgctggttgtgctggatgcgacaaccggacagaatgcgctggttcaggcaaaggaattttccgatgtggcaaagatttccggaattgtgctgacaaagatggatggaacagccaagggaggaattgcggtggcaattcaggcggaacttggagtgccggtcaaatatatcggcgtgggagagaccattgatgacctccagaaatttgacccggatgaatttgtgaatgcattgtttgacgtaaaaaataaggaggacaacgatgaagatgctgacgctagataaatttgaagaagcaagtgaaaaagtaaaagaggttactctggagacaaaacttgtatacagtgattacttaagtgaccagacaggcaataaagtatatttaaagccggagaatatgcagtttaccggtgcatacaaagtaagaggtgcttattataaaatcagcacgctctcagaggaagaacgtcagagaggactgattacagcatctgccggaaaccatgcgcagggagtggcatatgccgcaaagtgctacggctgtaaggcggtaattgtaatgccaaccaccacgcctctgatcaaggtgaatcgtaccaagagttatggtgcggaagttgtgttgtacggagatgtatatgatgaggcatgtgcacatgcactggagctggcagaaaaaaatggatatacctttattcatccgttcgatgatctggcagtggcaaccggtcagggaaccattgcaatggagatctttaaggaacttccgctggtagagtacattcttgttccgattgggggaggcggactggcaacaggcgtatccacacttgcaaagctgctcaatccaaagattaaggtgatcggtgtggagccggctggtgcaaactgtatgcaggcttcatttgcagccggaaaagtgacaacgcttccgacagtaaatacaatcgccgacggtactgccgtaaagacaccgggaagcaaaattttcccatatatccagaaaaatctggatgacattatcacggtaacggatgatgaactgatcgtaagctttctggatatggtggaaaaccacaagatgattgtagaaaattccggactgcttacagtagctgcattaaagcatttaaatgtcaaggacaagcgtgtggtatccatcttaagcggtggaaacatggatgtgattacgatgtcctctgtggtacagcagggactgattttccgtgaccgtatctttaccgtttcggtattgcttccggataagccgggagaactggcgaaagtttccgagacactggcaaaagagcagggaaatgtcatcaaactcgaacacaatcagtttgtttccacgaaccggaatgccgcagttgaacttcggattacattggagtgttttggtaccgatcacaagaagcagattatcaaggcgctggaaaaggccggatataagccaaagatcgtaagaaccatgatttaaaaataaattacaaggtgtcaagaaaaaatacttgacaccttgttttctttatggtaaagtatccaaggtgattgatgtggaagaaaagttacaacaggcttatttatatgatttttatggcgagttactgaatgaacatcagcgccggatctatgaggacttcgtgttcaatgatctttctctcggtgagattgccggggaggaggggattaccagacagggcgtggcagatatgatcaaacgctgtggaaagaagctttcggattatgaaaagaaacttcatctggtagagaagttcttatctgtgaagcaggatgtggaggaaattcacagactggcagaacagtttcatcaaacaaaagatgaacagatcgtagaacagatcgcaacgatttcaaatcagattttggaggagctgtagtatggcatttgacagtctttctgaaaaattgcagaatgtatttaagaatcttcgcagcaagggcagactgacagaggacgatgtcaagacagcactgaaagaagtcaagatggcactgcttgaggcagatgtaaatttccgtgtggtcaagaagtttgtaaaagatgtgcaggaacgggcaatcggacaggatgtgatgagcggtctcaatccgggacagatggtcatcaagatcgtaaacgaagagatggttaagctcatgggctccgagacaaccgagattgcgttccggccgggaaaagaactgaccgtcattatgatggtaggtctgcagggtgccggtaaaacaactaccacggcaaagatcgcaggcaaattaaagaccaaagggaaaaagacactgctggcagcctgtgatgtgtatcgtccggctgcaatcgaacagttgcagatcaatggagaaaagcagggcgtggaagtattttccatgggaaataaaaacaaacctgcggatatcgccaaagcggccgtggaacatgcaaagaaagaagactgtaatgttctgatcattgatacggcaggtcgtctgcatgtcgatgaagagatgatggatgagcttgtggagatcaaagaagcggtggatgtattccagaccattctcgttgttgatgcaatgaccggtcaggatgcggtaaatgttgcttcgacatttaatgacaagataggaatcgatggtgttgttctgacaaagctcgatggagatacccggggcggtgcagctctttccatccgcgcagtgacaggaaaaccgattctgtacgcaggtatgggtgagaaactttcggatctggaacagttttatccggatcgtatggcatcccgaatccttggtatgggtgatgtgcttaccatgattgagaaagcacaggagaatctcgacgaggaaaaagccaaagaacttgagcagaagatgcgcaagaatgaatttgactttgaaatgtatttagagtccatgagtcagatgaaaaagatgggtggtttgtccagtctgatgggcatgatgccgggacttggactcggcggtggaaagatgccggagattgatacggacgaagcggagaaaaacatgcggagaatagaggcaattattcattccatgacaccgcaggaacgtaaaaatccgaatctgctcaatccaagcagaaagaaccgcattgcaagaggtgcgggtgtacaggtggcagaagtcaaccgtctggtcaagcagtttgagcagacaaagaaaatgatgaaacagatgcccggcatgatgggcggcaaacgtggtaaaagaggaatgttcaaaggacttcccttttaaataaaaaacaaaacctatgaggaggtgaaatcatggcagtaaagatcagattaagaagaatgggacagaagaaggctcctttctatagaatcgtagttgcagattcccgctcaccaagagacggaagatgcatcgaagagatcggaacatatgatccaacaaaggatcctagcgagtatcacgtagatgctgagctggctaagaagtggttatctacaggcgcacagccaacagagaccgttaacagaatcttcaaggcagctggtatcgagaaataattccgaagggtggatgtaattaatgaaagaattagttgaagtaattgcaaagtcactcgttgatttcccggatgaagttgttgtgacggagtctgagaatgaaaaaggaactctgctggaacttagggttgcacagtccgatatgggcaaagtaatcggaaagcagggacgcattgcgaaagcaatccgtgcggttgtgaaagcagcggcatccaaagaagacaaaaaagttattgtggaaatcatgcaataacataacggtaggatataccgcattaagcaccccgcagttgcgaggtgcttgtttttctatgaaacaaattcatgagagaatctgcacaataggagattttatggaagatttatttcaggtgggagtgattacggctcctcacggggtacgtggagaggtgaaagtgtttcctaccacggatgataatgcccggtttaaaaatttgaaaacagtcctccttgatcagggtcggggaaccagagaacttgaaatcgaaggtgttaagttctttaaaaatatggtgatcctgaaatttaaggggatagatgatagaaatgacgtggagagaatgcggcaggcaaagctgcttgttaccagggaaaatgcagtggaattaggaaaagacgagtattttattgcagatctgatcggaatacaggtggtttcggatgaaggagaagaacttggaacaatctccgatgtattgcagaccggtgccaatgatgtctatgttgtgagtaaagacggcgcaaaagatctgctcattccggcaatccatgcgtgtatccagaacgtggatgtggctgcgggacagatggaagtacatctgctgccgggactgcgttaaacggagggtggacaatgaagtttcatgttttgacgctttttccggatatggtgatgcaggggcttatgacaagcatcacagggagagccgtgcaacagaaaaaaatagatattgatgcggtgaatatccgtgattatacgcaggataagcatggcagggtggatgattatccttacggcggcggtgcagggatgctcatgcaggcacagccggtatatgatgcatgtcagagtgttatggaaaagataccgcagaataagaaaaagcgggtgatttatgtaaccccgcagggaattccttttacacaggcaaaagcacgggaactggcggcacaggatgagctgcttttgttatgcgggcattacgagggcattgatgagcgcgtgcttgaggaagtggtcacagattacatttccatcggtgattatgtactgacgggcggcgagctggcagccatggtgattgtcgatgcagtggcacgcctggttccgggagtgcttggaaatgaacagtcggccctgaccgaatctttccacggagagcttttggaacatccgcaatattccagaccggatgtgtggcacgggaaaaaggtgccggaggtgctgctttccggaaaccagaaacacatagatgcatggaaaaaggaacagtccatcctgcgtacaaaggaacgcaggccggatctgtatgcccgttatgtgcggctgcaggaatgcagacaactgcttatgaaacagaaactgttgcacatcgatatgattgaactgatcaatcgtggacgcgcacaactgttgtatttcgggcagggacagatattgctcaaagatatggaatacgagatctattttcatgcatgtgttgatccgtcaagacttccggatatccgtacatggacgcttccggttgaaaaaataccgctggcggttttgcatcaggaggaaatgattccttattttcaaaagagatacggacttaatcaggagtgcgaatgttatcaggctgtgtacaccagacatgaaaagcttccggtgcgcgggttataccggccggatctgacgcgtgaggatggattgtcgatgcgcagattacaacgagaagattttccacaggtggtttccttttatcacggctgctgtgatgaggactacctgcggtcgaggatacaggatggtatgcttgtgggggctttttatgacgaaaagcttgccggatttatcgggcagcattgtgagggaagtatcggaatgcttatggtagcaccaaaattccagcgcagacacattgccatgacgctcgaaacgtatgcagcaaactgtatgctcgaacagggaaaaattccgtttgcacagattatcacggacaacgaaaaatccaagagattgcaggaaaaagagggattttgtctgtcgcgtgacaaaattttctggatgtgcgaaaaatgatgaaaaaggacttgatttttcggaatgagtatgctaaagtttataattgttgtggtgtaattatccggtaatattacggaacggatagttacaaatgtgaatagaagtgacggtcctctggcaccgatagatggagtttaagaacgtcaaaataatcaggaggtcacaaaatgaacgcgagtgaaattatcaagaacattgaggcagagcagttaaaggctgaagcaccacagttttccgtaggtgatactgtaaaggtatacggaaagatcaaagagggaaaccgtgagcgtattcaggtattcgaaggaactgttattaagaagcagggtggaagcaaccgtaccactttcactgtaagaaagatttcaaacggtgtaggtgttgagaagacatggcctttacattctccaaacgttgagaaggtagagatcgttcgtaaaggtaaagtacgtcgtgcaaaactttactacttaagagaccgtgtcggcaaagctgcaaaggtaaaagagttagtaaaataatttgcttcatggaagggatgccacagaatgcggcatcccttttttctaacttgaattaaagaggtggaaaagtgaaaagaagaagcggactgaatttcagcagaagaagaaaaaagtttaatgtgcccctgtttaaagaaattatgacctgggtattagaatgtgccattgtaattgccattgcatatgcactggtcagttcttttggttttcggacgacagttgtgggaaatgccatgcaggataccttacagagcgaggaacagatttttgtcaatcgctttgtctatatggtacgcgcgccaaagcagggcgatgtcgtcgtttttttgccgaatggaaatgaaaaatcccattattatgtccggagggtaattgcttgtccgggggatacggtacagatcaaaaatgggaaagtatatattaatggagaactttacaaggaagatattgtttctgcttccatcgaagatcccggtgtggcagcagatgaagtgaaacttggagatgacgaatattttgttctcggggataatcgaaacagcagtgaggacagccgtatggcaaatatcggaaatgtgaaaaaagattatataattggaaaagcgtggttccattttaagggattgggaaagatgggactgatcgattaagcgggctgatttaggaaatgaggaaaaagagatgaattttcaatggtatcccggtcatatgaccaaagcaaaacgacagatgcaggaagacatcaaactgatagatctggtgatcgaactggtagatgcccggattccgctcagcagcagaaatccggatattgacgaacttgggaaaaacaaatatcgtctgattttaatgaataaagcggacctggcggaccgcaaggcaaccgagcagtggtctgcttttttcaaaaagaaaggatattatgtggtaagccttgacgcgcgaagcaaaaacggaatgaaatccattaccgatattattatggaagcctgtaaggaaaaaatggagagggaccgtaagcgcggaatcaaaaaccggccggtccgtgccatggttgttggaattccgaatgtcggaaaatccacatttatcaattcgtatgcgggaaaagcgtgtgcaaagaccggaaacaagccgggtgtaacgaagggaaaacagtggatacgtctgagcaaaagtgtagagcttttggatactccgggaattctctggccgaaatttgaggatcagaaagttggacttcgtctggcgctgatcggttccatccgggatgagatcttaaatacggatgaacttgcggtagagctgatccgtttcctgaaaacacagtatccgggaattctgacagaacgttatgaagtcgaagaaacacaaaaggagaccgaacttttatgcgggattgcagaaaacaggaaatgtatcacgaaaggcggggaactcgattacagcaaagcggcagcacttctgattgatgaattccggagcggaaaactcggaaaagttacgctggagtggccaaaggagcaggaaaatggctgaaaaaattgatgcgattaaagaggaactgacagcaacaccgacggaagcactggaggcgtttgtggaaaaatatgcgtcggattcccgcaccggtgtgcagaaactggtggataccgcaaaaaaacgcatggataagctacagaaggaaatgatccgcacggaaaatttaaagaaatatgaaaaagagtacgatacatatacatatatctgtgggatcgatgaggtaggacggggaccgcttgcgggaccggtcgtggcaggagctgtgattctgccgaaggattgtgatatattatatattaatgattccaaaaaactttcagcggcaaaaagagaagaattgtatgatatcatcatggagcaggcagtggcaaccggacttggcacgatcggtccggacgggattgatgagatcaatattctgcaggcaacatatgaggcaatgcggcaggcgattgcacagttatctccgcagccggatctgctgcttaatgatgcagtgacgattccgaaagtgacaattccgcaggtaccgattatcaagggagatgcaaagagcatttccgtcggtgcggcatcgatcattgccaaggtgaccagggaccggatgatggtatactatgattcgatttatccggagtatggttttgcttccaataaaggatatggaagcgcggaacatattgcagcactcaaaaagtatggaccgacaccgattcacagaagaacctttattaagaattttgtatcataagataattattcaaaatcacaaagggggctgttcggatgcagatttcagatttggtaaaacagtatcatcaggcgatctcatcaggtgcggagacgctgaccgggacgaaaggtgtggaaaatcttgtggcctctctgcggtctctgacaaaaggaaatatttttgaggggacggtcacttccgttaaaaatggccgcgtgacgctttctctttccggagggcagcaggtgatggcacggctggacggaaagatttcccttatggaaggggaatccatgtttttccaggtaaagtccaacgatggcacgcagattgccatccggccgtttgcaattgacggggcaggcgcaaattatacgctgatgcaggcgctttccgcagcgggactttccgcacagccggagtatttgtccatggttgaccggatgatggaagaacagatgccgattgaccgggagagtctgcagcagatggcacggctggtcaatgcaaatccgcggattgatgtacagacgctggtacagatgcaaaagcttggaataccgattactgtagaaaatgcctcccagtttgaaaattatatgaatgacagtcaggcgattacacgggaactggatgcactgattgagcagtttccacagagtctgaccggaacagaaggcgcaccagtaaagacagagaccatgcgtcagcttggaaatgagttgttgcagattctgacagacgggctggaagaagtaccgcagcagatacaaagtccggaaccggatatggcatacaacctggatggtctgaattatgaaagcgtgcagacagataccgcagaaacgcagatgcagacggaagctgcaccggagactgccacggaaaccgtgcaggaaaatccggaaattttgtcgcagcaggaaggtcaggctgcagcggaggagaaaggcgtggccggacagcaggaagccgaaacgatggaaactgtttccggaaaaacaacttataccgggcagatgtcgcagactccacatacactgggagctgtactttcacaggaacagctgcagcatttaaaccggatgatcggagatattctcggaaagccgcagagtgcatataacgcaaatagcggtacggtagaagtgttaaaggatctgcagcagctgtgcaaagatccgctgccgttggagagggaacatctcggaaagctgttttcttccagggaattccagaaacttgtccgggatacggcagaacagcagtggatggtcaaaccgggggatctcaaagagggcgattatgtgggcagactgtatgaacgtctgaacagtcagatggaaaaaattgagtctgcactcaaaaatgcgggacaggagcatactgctttttcacagatggcaggagagatccacagcaatgtggaatttatgaaccaggtgaaccagatgtatacatatgcacagattccgcttaaaatgtcggggcagcatgcaagtggcgaactgtttgtgtataccaacaaaaaggcactggcgcagggagaaaaggatctgactgcttttttgcatctggatctggatcatctgggaagtacggatgtttcggtccggatgagaggacgtgaagtaagtacgcgtttttatctggacaatgacactgcatatgcattgctggaaaaaaattatccggtgctggaagcgaggctggaaaaaaagggatatcactgtaagatcgacgtggtaaatgaagaaaaacatgtaaattttgtggacgattttctgaagatggatcagccggcggcgacacagctgcaccggtattcctttgatatgagggcataaaatggaaaataataattttaaaccctttccgtttgagcagttaaaacaaaagaaagaaccggagaaaacggcagtggcgattgcctatgagccgggcgaaaaagcaccaaagatactggcaaccggaaaggggcaggtagccgaaaaaattattgaaaaagcaaaagagagtcaggttccgacttacaaagacaataaacttgcgtctactctttccaaattgcagatcggggacatgattccgccggagctgtatgaggtggttgcggagattcttgtttttgtggatgatatggatcgtatgaaggcaaagattgatcaggcaggggttaaataaaatttgaataaacgtacaattggaacagaatatgagaccatggcagcccggtatttgtgcacacatgattacacaattcttgcacgcaattaccggacaccatttggagaggtggatcttattgcacaaaaggacggggtacttgtatacgttgaagtaaaataccggagcagcaatgattacggagatccgttagaggcggtagaccggagaaagcagcgccagatctgtaaggttgcaaattatcattatgcaggatatgcagcagggcaggagatggactgccgttttgatgtgattggaatttatggggacggaagtatccggcacatcccaaatgcattttattttcagaggtgacagacatggacagagaagattttcagtggaaaaataaagagcatatactggaactggaacagtttcagggcaaaaagggacaggggcttccgcttttgtattttccccttcttttggcacatacgggcgtaaagaactgttttaccactagagagggtggatgcagcaccggaatgtttcagagtctgaatctgagttttacacgtggagatgatccgcaggcagtgacggaaaactaccgcagagtggcagaggcaatgggaggaacgctttcggatattgtctgttcggatcagacccatacgacgaatgtccggcgggtggatagaagctgcgggggctatggtgtgacaaaggagcggccttacacggatgtggacgggctggtgacggatgaaccgggactgattctggcaactttttacgctgactgtgtaccgctttattttgtagatcccatacaccatgcgatcggactttcccattccgggtggagaggaacggtcggacgcatggggcagcataccatcgaggtgatgcgcagggaatttcatagtgaccccggagaaattcttgccgccgttggaccgtccatctgtcaggactgttatgaagtaagtgaagatgtggcatctgcctttgcaaaagagttttccggtcatgagtgtgagatcctgatcgaaaagggcggtggaaaatatcagctggatctgtggaagagtaatgagattgtgttgcgggatgcaggaatccttccggaacatctggcggtaacgaatctttgtacctgctgtaatccgaatctgctgttttcccatagggcaagccatggaaaacgtggaaatctgggagcatttttaaaacttgtgtaacaaattaagaaatccttaagaatgtatttcaaagatgttaaattactcggggaagatttatggtacactgactgtattgaggaaagataggaggatgctctttgatgcagccagattgcagagatatcaaaccggtctatgagcagatcacggacgggattcgaaaaatgatcataacgcatgcgataccggagggagaaaaacttccgtcagtgagggaactggcttcaaaatttgccataaatcccaatgctgtaaggaaagcttatcaggagctggaagaggaagggtatgtctgtgacagggaaggcgaacggatggcggcatcggaaaagcagattgcggaactgatccgcaaagagctgctgcaggagttcgacacggtggtaatcagactgcagaatatgtcggtagggacagaggaattgacaggacgtatgtgggaactggcaggaggaagcaaagactttgattgaagtaaataatctgataaagaaatttggggatttccgtgcgctcgacggggtaaatatgcatgtggcgtctggaaacatatatgggcttgtgggaccaaacggtgccgggaaatcaaccctgatccgtcatctgacaggtgtataccggcaggatgccggagaaatttttattgacggggctccggtatatgaaaataaacaggtaaaggctcaaatggcttatataccggatgagccgttttattttttacaggcggatacactggaaatgatgcgttatttccggggaatgtacgagtcctttgacgaaaagatgttttatcgcctgcaggagtttttcccgggaattgatatgaaacgcaatatccgcagactgtccaagggaatgcaaaaacaggttgcattctggctggcactctgctgcagaccgaaacttctgattctggatgaaccgctggatggccttgatccggttatgcggaaacagatctggacgatcctgatgtccgaggttgcagagcgcaggacgaccgtactggtttcttcccataatctgcgcgaactggaggatgtctgtgatcatgtgggcattatgaatcacggaaaggttataattgagcgttccctgtttgatttacatggaaacatcagtaaaatccaggtggcatgccagaccggtatgccgaaactcccaaaagaatttgaggtattgcatatgtcaaattccgggcgtgtatatacaatgattgtcaagggaaatcccagggaggttgcggcagccatccagacagagggagaccatctggctattgtggacattctgccgcttacactggaagaaatttttatttatgaaatgggaggtttgggctatgaagtcaaagacatccttttttaaccgtacggtttttaaaaaaaatatgaccctgtactggccgatctgggtatgctatctgttatatgggatggtaaaagtgccggggcagctgtggtcgcgtctgcagcaacagacggacatgactgcttatgccagggattatgcattgtacaacagtctgcgtctggaagtggatgtggccgcaattgcaattatggcagtcgtctgtgggatggcgttgtttggctatctgtttacccagaagaatgcgtatatgatccatgcactgccggttacaaggggggaactgtatgtgacgaatatgatcagtggcctttgttttctattgattccgcaggcactggtttttctggtaacggtggttctttgtcttttgaaaggcattgcgagtgtgcagtttctgggattgtggtttttaagtgttatgggaattgcttttttcctttatgcaacggtgtgtttttgtgtcatgtttaccggacagctgtttgcacttccggtgtactttctggcagttaattatgtggcatttgcattttccagcggtgcacgttatgtcatcggatatctgggatatggacttggcatggatactgtgccggaatttttaattttgcggattctttccccgatgaattatctgtacaacaatgtgcggtttgtattccggcaatcctataaccaggaaacggatctgatgtcgggggtgttgtcctaccggggactgcgggtacttgcggcctatgtggctgcagcagttgtcatttatctgattgcttattactgttataaaaaacgcaggattgaaagtgcaggggatctgatttcttttaactgggtaaaaccattgttccgctggggcgtgggaaccggagtcggttattttgcaggcgtcctgatggcagaatttttagattccgtgcatctgcatgtaaaaaaaccaatgttgcttgttcttgtggtggcatttggttttgtcagtttttttattgcacagatgtttgtggaaaaaggatttcgcgtattttgccgccggagattctgtgagagcgggttatttgtgctgtttgtgctgggcagtttctggggatgctcaaaaaatgccacctatctggaacagtatgtcccggatgcagatcaggtaagccgggtggaagtttctcttgattatccggtagaatataaaggggacagcgttcgtgtggcacgtcaggcacagaaagaaattttaagtcatgcggaaatttacagggaaaataaaacggatgacagtacacagatcattttttattactacctgaaaaatggaaaaacgctctcgcgtacatatgagattacagaggaaaatgaaaagctttcagaagtattatttggagaagaaaataaagcagatcattttatggaatatctctttggaacggattatgacaaaatttcaaagtttaataccggaaccctgacattagacgaatcatcggaaaattataaggattgtgactttgatgcggatactgcaaaaaaactgtatcaggcgatttgtgaagacgccgcagatcagaagctgcaaaagtacaatctgacaaatgcactgaaagatccggaagaaacaggggagtactcttctgccagtctcagcatggatttttatcacgtatctgcagactggaaaaatgtatatgaccggctcgatgattactacacgaatatgggcgaatctgtggaaacatccagaccatatggcggatcagcatatgtcagcttcgggaaagactgtaccaatatcataaataccctgatagaatgcggggtcattgacgatgtttcggaaattcattttttaagttccggagataaaacatcacagggatgaaatcagcaggactttacaacttccgcggcttattgtaaaataaagatggcgttttcggacgccatccatttttttgttggaggtaaaaaatgagcagaccagtcgtagccattgtcgggcgtccgaatgtcggaaaatctacgctttttaatacattggcaggagagagaatctccattgtaaaagacactccgggtgtcacaagagaccgcatttatgcggatgtcacatggctgaactataattttacattgattgataccggtggaatcgaaccggacagcggggatgtgatcctttcccagatgcgtgaacaggcagagattgcgattgccacggcagatgtgatcatgtttatcacggatgtgcgtcagggactgcaggatgcggatgcaaaagtagcggacatgctgcgcagatccaaaaagccggtggttctggtggtaaataaagtggacagttttgaaaaatttatgccggatgtgtatgaattttacaatctcggaatcggagaaccgtatccggtttccgcttcttccatgctcggacttggagatatgctggatgaagtggtgaaatatttcccggaaggatcggaaaatcagccggaggatgaaagaccgaaggtagccattatcggaaagccgaatgtcgggaaatcatccctgatcaacaagctggcacaggaagaccgtgtaatcgtatcggatatcgcgggaactaccagagatgccatcgatacagacattaaatacaacggaaaagaatatgtatttattgatacggcggggcttcgccgcaaaaacaagatcaaagaggagattgagcgctacagtattatccgtgcagttaccgctgtggaacgcgcggatgtggtgatcatcgttattgatgctaccgaaggagtaaccgagcaggatgccaagattgccggaattgcacatgacagaggaaaaggtatcattattgcggttaacaaatgggatgccatcgaaaaggataacaacacggtgaagaaacataccgagaaaatccgtcagatcttaagctttatgccgtatgcagagattttgtttatttctgcaaagtccggtcagcgtctgaataagatttttgaaatgatcgatgttgtcattgagaacaacagtatgcgtgttgcaacgggtgtcttaaacgaaatcgtcacagaagcagttgccatgcagcagccaccgaccgataaaggaaaaagactcaagatttattatgtaacacaggttgcggtcaaaccgccgacatttgtcgtatttgtcaatgacaaaaatctgatgcatttttcgtacaccagatatctggagaaccgtatccgcgatacatttggattccgtggcacggctcttaaattcatcacgagggagcgaaaggaagactagttatgatgatcgttgcaagaatcattgcattactgatcggatatggattcggtctgtttcagaccggatatctgtatggaaaaagtaagggaattgatatccgtcagcagggaagcggaaatgcaggcacgacaaattctttgcgggtgcttggatggaaagccggcattattacatttgccggtgatcttctgaaagcagtatttgccgtacttcttgtaaaactgatttttcacggaacgtatggggctgatacaaaggtgctggaactgtatgccgggtttggaacagtcttaggacataattttccgtgctatctgcagttccgcggcggaaagggaattgcctgtacgacaggcgtcatccttgccgtctgtcctccggcagtaatctgctgtgccgttggattcctgattattgtgggaattacccggtatgtttcggtgggttccatatttctggtatctgcctatctggtacaggcgattattttcggacagattggctggttaaaaatcagcggagccagccggatagagttttacatattgagtgcatgttttaccggcatggcgatttggagacaccgtgcgaatattgttcgtctgatgaatggaacagagaacaaattcggaacgaaaaaaggagataaatgatatggcaaaggtaggagtgatcggagctggcagctggggcattgcgctggcaaagcttcttcgtaccaatggaaatgaagtaacggtatggtcgattgtggaagaggaagttgccatgctccgcagagagcatgagcatatcgataaacttccgggagtgaagcttccggaggatgtcctgtttacaacagatttaaaagaagcaatcgttggaaaggagttcctgattctggcggtaccgtctgtatttacaagaagcaccgcaaaaagtatggcaggatatgtgacagaaggacagatcattgtctgcgtggcaaagggaattgaagaagataccctgatgaccatttccgatgtgacagagcaggagattccatgtgcggatgttgctgtcatgtgcggaccgtcccacgcggaagaggttggaatcggacttccgacaaccgttgtggcaggagcaaaaacagaaagcactgcaaaaaaaatccaggatctgtttatgaatgaagtgttccgtgtttataccagcccggacatgcttggcatggaactgggcggatcattaaaaaatgtgattgcacttgctgccggaatggcggatggactcggatacggggataacaccaaagcggccctgattacccgcggcattgcagagattgcgggacttgccgtaaagatgggggcaaaagtggagacgctctgcggactgaccggtatcggagacctgattgtcacctgtgagagccgtcatagcagaaaccgcaaggcgggtatgctgatcggacaggggtataccatgaagcaggctaccgacgaagtgaaaatggtcgtagagggaatttattcggccaaggcagcacttgctctggcaaaaaagtatgatgtggagcttccgattatagaagaagtgaataaagtactgttcgatgacaaaccggcaaaggaaggtgtaaaggatctgatggtccgcgaaaaacgtgtggagcatctgaatctgaagtgggaaaactgatatgcagaaaatcaagattaaatattttacagacaaaatcgaaccgctggattacattgaaggaaaatccgattggattgatatgcgggcttcggaagaagtaactttaaaagcgggagagtttgcactgatcccgcttggcgtggcaatggaacttccaaagggatatgaggcacatcttgtgccgcgcagttccacatttaaaaactggggaattatccagacaaacagtgtcgggattgtagatggttcctattgcggggacaacgatatgtggcggatgccggtttatgcaaccagggataccgtgatccacgtaaatgaccgcattgcacagtttcgaatcgtggaaaaccagccagagattgtatttgaaaaggtggaacatctgacggggaaagatcgcggtggctttggcagtaccggattatcataacaataacagcaacaggagaaggaggattatactatggaagatcgtatgatgaaattttattcaaaagaaagcaacatgctggcgctgcatgccatgcacggacattttgcaacgagtcattcccacattaattattatgtggatgtgacaagtatcaagacacgtgtggcggaagcaaaacaggcggcacatgtactgtattcgagaattccaaagacaaaatacgtggataccattgtgtgtatggatggaacggaagtggtcggtacctttctgacggaggagatccagcgggacggaattatgggcaccacaaaccagcatgagacggtgtatgtgatttcgccggagattaacagcaataaccagatgctgtttagggataacaataaagctgccatcaacggaaaacatgttgtgcttcttttagcaactacgacaaccggcgagaccatccgcagagcactcgagtgtatccagtattacggaggagagatcgagtgggtggcttctttattcggaacgatcaattcggtagacggcgtagaagtcgagacactttttgatgaaaatgatgtcactggatatgcggcatatccggttgcagactgtccgctctgccggcagggacaaaagattgaggcgatggttaacggttttggatattcaaaactgtaatttttgggggcattgtttacaacaatgtcccctttcgttatttcgccaagaaaccatgtaaatatttggacggattgacggtggtaatttcgggcagattccgttatcatacacttgtcaggaagttcaaagaaacttcaccaaagaaaaataacgaaaagcaaaaatcaggaggtttttcaaatggcaagtttatcattaaagaacgtttgcaaagtatatccaaacggatttgaggcagtaaaagatttcaatctggatgttgcagataaagagtttatcatcttcgtaggaccatctggatgtggtaaatctacaacacttcgtatgatcgcaggtcttgaggagatttcttccggtgatctgatcatcgacggaaaggtaatgaacgatgtagagccaaaggatcgtgatatcgcaatggtattccagaactatgctctgtatccacatatgacagtatttgataacatggcattcggtcttaagttaagaaaagttccgaaggatgagatcaaagcaaaggttgaggaagcagcaagaatccttgatctggagaagttactggatcgtaagccgaaggctctttccggtggacagagacagcgtgttgccatgggtcgtgcaatcgttcgtaatcctaaggtattccttatggatgagcctttatccaacctggatgcaaaacttcgtgtacagatgagatctgagatcgcttctttacataacagattaggtgctacgatcatctatgtaacacatgatcagacagaggctatgacacttggaaccagaatcgttgtattaaaagatggtgtaatcatgcaggttgattctccacagaaattatacaatgagccaaataacttattcgtagccggattcatcggatctccacagatgaacttcatcgatgctaagtgcaccattcagggagataaagctacattaacattcggtgattactctgtggttcttccggattacaaggcaaagaagcttgaagagggcggatacaacggaaagacagttgtattaggtatcagaccagaggatatctctgatgatcctgaaatgatccagaagaatggtgactgtgtcatcgagtctgatgtaacaggatacgagttacttggtgcagaagtattactgtactactctgtagccggtgcaaacatgacagcaagagttgattctgatacacctgcccgttatggcgatcatatcaagcttgcatttgatccgcataagattcatgtattcgataaggaaacagaattgacaattaccaactagtccgttaaaattatatagttgtaaatcttgaacccgggtgttagtatttacacccgggttctttcgaacgtaaataataggagagtatatgctttcaaatcagaaattacagaattcattaaacgaaattaaagagatcagccacatggatacggcattgtttactgcaaaggggaagctggtagcacatacggaggagatgccgttgccggaggcattagaacagcaggtggtcgttgatttcgcagaatcgcttgctgaaaaacagacgtatcaggattatcatctgtataaagtgatggtagaaggtgaaacggaatatattttagtctgtctggtgaaagaagagtcatttcttgtatgcgcacagatggcagtctgccagatccggaatctggttatgagttttgcagagcagttcgaccgcaataattttatgcagaatatcattcttggtaatatgctgattgtggatatttacggaaaagcaaaaaagcaccacattcaggaagtaccgcgggtagtttttgtgattgataccggaagtaaaaataacgatatggcgatggaactggtaaaaaatcttgcagatatccgttcgaaggactttgtgacctgcgtggatcagcacagtatcgttctgatcaaagatgtttcccatataaaagaagaggagatggaggaacgtctgtcaaaaattgcgggaagccttgcagataatttacatatggaagcaatgattcgtgtgcgtgtcggttatggaaacgttgtgacacagcttccggaaattgcggaatcttatcaggaagcgcggatggcactggaagttggtcgtgttttttatgcaaagtatgacacaatttcttacggaaagcttggcatcgggcgtctgatttaccagcttccgatgagtttatgtaatatgtttatcaaagaggtattcggtgagaaaattccggacatcttagatgatgaggaagcaatgtctactatcaataaattttttgagaataatctgaatatatcagagacggcaagacagctgtatgtgcaccgcaatactctggtatatcgtctggaacgtatcgagaaagcaatcggactggatatccgtacgtttgacgatgcgatgacttttcggattgcagtgatggtgattgctcacatgagagatcaaatgtaatttagcaggatagtaaggagatagaggaacatgtcaggatatgatgcaagcagtatatcggtactggaggggcttgaagcggtccggaaacgtccgggaatgtatatcggaagtacaacgaccaaaggactcaaccacctgatttatgagattgtcgacaattccgtggatgagcatctggcaggtgcctgtgataaaatatgggtgacccttgaggcagatggctcctgtacggtggaagataacggacgtggtattccggtcggcatgcatgcaaagggagtatcggctgcccgcgttgtattttctacactgcacgcaggaggaaaatttgacaacaatgcgtacaagacgagtggaggactgcatggtgtcggatcttcggtagtcaatgcactttccacctatatggatgtggaaatcagccagggcggatatgtgtatcatgaccgctatgcacagggacatccggtggtagaacttgaagacggacttcttccaaagatcgggaagacaaagaagaccggaacgaagatcaattttcttccagatccagaaatttttgaaaagaccagattccgggaagatgatgtgaagagccggatgcatgagaccgcttatctgaacccgaaactgacgatcatatatgaggatcggagaaagccggaagcagagcacattgagtttcatgagccggatggaatcattgggttcgtcaaagatctgaacaataatcttgaagtgctgcatgatgtcatttacttcaaaggggaaagtgaaggcattgaggtggaagcggcattccagtataccagcgagttccatgagaatatcatgggattttgtaataatatttataattcggaaggtggtgcacacctgaccggatttaaaacggcgtttacgacgattatcaattcctatgccagagaacttggcattttaaaagagaaggatgcaaatttcaacggtacagatgtgcgaaacggaatgacagcagtgatttccatcaagcatccggacccgcgttttgaaggacagacgaagacaaagctcgataatcaggatgcaaaccgtgcaactgccaaagtgacaagtgatgaagttccgctgttttttgataaaaatttagaaaccttaaagattgtgattggctgtgcggaaaaggctgcaaaaatccgcaaggcagaggaaaaagcgagaaccaatctgctgaccaagcagaagttttcgtttgattccaatggaaaactgtccaactgtgagagccgggatgcgtcaaagtgtgagatttttatcgtagagggagattctgccggtggttccgccaaaatggcgcgaaaccgtatgtatcaggcgatcatgccgatccgcggaaagatcttaaatgtagagaaagcaagtatcgacaaggtgcttgccaatgcagaaatcaagacgatgatcaacgcattcggctgcggtttttcggaagggtacggaaatgattttgatatcagtaagctgcgctatgacaagattattatcatggcagatgccgatgtcgacggagcccatatttccacgctgcttctgacactgttttaccggtttatgccggaactgatttttgaaggacatgtgtatgtggcgatgccgccattgtacaaagtgattccgtcaaaagggaaagaagagtacctttatgatgatgcggcactggaaaaataccggaaaacacataccggaagttttaccctgcagcgatacaaaggtctcggagagatggatgccgagcagttatgggagactactttaaatccccagacgcgtgtcatgaagcgcgtggagattgaagacggccgtatggcgtcggatgtaaccgctatgctgatgggcacggatgtgccgccgagaaaggcctttatttatgaacatgcaaacgatgcgatcttggacgtatagatcctgttaggttttctaggagtgaggaagaaataaaatggaacatagtatcattcgcaccgagtattcggagctgatgcaaaaatcatatattgactatgcgatgagcgttatcattgcccgtgcgctgccggatgtccgtgatggattaaaaccggtgcagcgccgtacactttatgatatgtatgaactgggaatccgatatgacaaaccgtatcgtaagagtgcgcgtattgtcggagataccatgggtaaatatcatccgcatggagattcttcgatctatgatgccctggttgtcatggcacaggatttcaaaaagggactgccgcttgtggacgggcatggaaattttgggtccattgaaggcgatggtgccgctgccatgcgatatacggaggcacgtctgcagaaagtaacgcaggaagcctatctggcagatctggataaaaatgttgtggatttcatgccgaattttgatgaaaccgaaaaagagccggttgttttgccggtaaaggtgccaaatcttctggtcaacggtgcggaaggtatcgctgtcggtatggcaacttccattccgccacataatttcggagaagtgatagacggtgtgattgcctatatgaaaaatccggatattaccactgcggagatgatgcagtatattccgggaccggatttcccgacaggaggaatcattgcaaataaagatgatcttccggcaatttatgagtccggggtcggcaagatcaaaatccgtggaaaaatcgagattgaaaagggcaaaggcggcaaagaccgcatggtaatcacggagattccgtataccatgatcggagccaatatcgggaagtttttaaatgatgtttacggtctggtagaatccaaggcaaccagtgacattaccgatattaccaatcagtcatccaaagagggaattcgtattgttctggaactgaaaaaaggagcagatatcgaggctctggagaatctgctgtacaagaaaaccaagctggaagacacctttggtgtcaatatgcttgcggtagcggatggcagaccggagacgatgggcgtcgtgccgatcatccgtcatcatgtgaaattccagtatgagattgcaaccagaaagtaccagacccttctggcgaaagaacaggacaaaaaagaaatacaggaaggtctgatccgcgcctgcaatgtcattgatctgatcattgagattttacgcggcagccgcagcatcaaagatgcaaaagcctgtctgacagacggaaatacggatcatattacctttaagaatccatcttcaaagatcatggcacagcagctgaattttacggatcgtcaggcacaggccattctggaaatgcgtctgtataaattgattggtctggaaattgaagcattgatgaaagaacatgatgagacactggaaaatattgcaaaatatgaggatattttagagcatcgttcttccatggcaaaagtaatcatcaaagaactgaccgcgtttaaaaaagcttatggcaaagagcgcaaaaccgtgattgacaatctgaaagaagctgtagttgcagcaaagaagatcgaggagcaggatgttgtctttctgatggaccgcttcggatatgcaaagattgtggatacttctgtctatgagagaaataaagaggcggcaaacgcggaatataggcatatctttacgtgcaaaaatacggataaaatctgtatctttacggacaagggacagatgcatctgctaaaagtgcttgatcttccatatggaaaattccgggataaaggaacaccgattgacaacctctgcaattatgacagtaaagaagagaatgttgtatatctggcaggtcttgaacatgtcagctcgcaccggatgttatttggcacaaagtatgccatgatcaaagttgtggacggtatggaatttgtggtcgcaaaaaagacaacggcggcaacaaagctgggagaggaagatgaagtactaacggtatgtccgttagaagaaaatgatacactggtgatggcaacaaagaaagatatgtttcttcggattgactgtgcacaaattccgcagaaaaagaaaggtgcggtgggcgtgcgtggcatgaaactggctgccggggatgaactgaaaagtattcatgtgctgcatgaaggtgaggagaaagaggtcgaggtgaaaggaaagccggttgccctgcatcgtctgcatgtgggaaaccgcgataccaaaggagtaaagaaataatgaacaccattttgtttgatctggacggaacgcttattgattcttccgagggaatcataaaatgtgttttatatacgcttgatttttacggaattaaggagccggatacggcaaaattataccggtttatcgggccgccgctttcggagagttttgaaagatattatggattttcgcatgaaaaagcgtatgaggctgtgcagaaataccgggaacggtacaatacgacgggaatttttgagtgtaagttatatccgggtgtggaaaagtgtatccgtacattaaaagaacagggataccggattggcatggcatcttccaagccggaagtatcctgcaaacggattctggagcattttggaattcttccgctgtttgatgatgtggtaggtgcaacatttgatggtacacgggataaaaaatccgagattcttaaggaagtcatgcaccgctggagtcatattccaaaatccgagatgtgtctgatcggggatacgatgtttgatgtcaacggggcgaaagaacttggaattttctgtattgcagtcagttatgggttcggggatgtggaagaaatgaaagcagcaggagtagcaggcatgtgcgattccctagagcagcttccggagctgctgcgtaagctgcatacatgtgacgtgcataaaaaccgttaaaaaattaagcggttgtaaacgcttaacatagaaaataattgggaaaagagaaacgggaggatatcgtatggaattttttaaggagattttagggaaaatatggtatattctatacccgtttcttttttattatgcggtgatgctgattattatgacaattgcgcagtgggcatttggaggagatgccacacattatgtgttctgtcagctgattgccactgtttttacaattccttccatggtgccgatgtaccggcagggacaggcactggcagggatcgcaaagcagccgtttggaatcaaccgggagcgtatctgtcatgcgctttttgcggctgggatcatggcatgctttggaatttctttgaacaatctcatatccatgatgaagctgacggaaatttcgatgggttaccagcaggcaaataccgatttttacggaagtacaataggaatggaaattctttgtctggcagtgtttaccccgattctggaagaactggtattccgggggattctttttggaagattaaaagatatgctgtcgaaaccgtttgcggttggaatttcggcactgatttttgcagccgtgcatgtcaatatcgtgcagttcatttacgcactgattctcggtgtggtgctggcacttctgatggatcgcgcgggaaatgtctatgcatccatgatcggacatatgacggcaaattttattgcggtagtccggacggaaacgcattggctggatttcagtgtcaggggagatgcggtcgcatggatattttccctgatgatactgggagttgggattgtgctgatgtggaggtatttgtctgacagaaaaacaatcgcctaaataaaagacaatagaaaaaaggagtacaaaagaagatgaaatgtttatggaaaaaagtaatttgcggggcacttgtggcgggaatgctggcacagtgcccacagagtatttatgcagaagatgccgcaaatactgccacggtaacggataccgagagtaatcatgtaacaccggatactacgcagcagccggatgatacaaaacagccgggagatacgcagcagccggatgatacccaacagccgggagatatccagcagccggacgatatccaacagccggaagaactgccacagccttctgccgtggagggactgcatacaacaaaacagggaaaaacaaaggtatatctggaatgggaagaaagcagcgatgccacttcctatgtgatttaccggaaaacagccggaggggaatacaaaaaacttgccgagaggagcaagccatcctataccgataaaaacgtatcatccggtaagacatatacatataaaattgttgcaaaaaacgagcagaaggaagcggatgaggctgcaaaagtcacgtttttgaatacagaggccgtacagatccggtcacagaagtatacttacagccagatgaaaaaagacatgcaggaactggaacagaagtacagcaactactgtgaaatgacaaaaatcgggacctctgtgcaggggcgtgccatctatgattttgcaatcggaaatccggatgcagaggaatcattactggtagtcagcaccctgcatgccagagagtatatctgttcggccgttctgatgaaggaactggagtattatctggaaaattataatgggacgattggcggggtaaaaccggcaaacacattaaataaaatacagatccattatattgttatggcaaatccggacggggtaacggtttcccagaccagacattccacatggaagtccaatggacgcggtgtggatttaaaccggaatttcccggcaaaacattttgtttccggcggaaagaaaggtgcacaggggtattccggcaaaaaagcactgagtgagccggaatcttatgcggtagcaacgctgacacagcagctgatcaaaaaacaaaatctgcagggtgtggtgaattaccatgccatgggaagaattatttacggggactgtacgaaaggaagcctgaaaaaagatacctataaaatgtatgatatcgcaaagaaaattaccggatacagcaaagccccggatagcggcagcggaaagtcctggggaggacagtaccgggagtatgtgatggatctgcttaataaaccttccattaccattgagattggaagctcagtagcaccgtgcccgtattggcagtatgagatcgaattccagaaaaacagatatgttgttgtgcggattgcaaatgcattgaaatagaaaaaaatcaggatactttgacgcatctgccggattatgctagtataggggaaacagctgacagatgaggagagtaaaaatggcatacatattttttgatatagacggaacgctgtgggatgaaaaaatgcagattccggaaagtacaattccaaccatcaaacaattgcagaaaaacggacataagacatttctgtgcagtggaagatcccgtagcaatattaacgataagcggctgcttgggatcggctttgacggaattgttgcagcatgcggaaaccatgtggagatggatggaaaggttctgtatgaaaatatcctttccccggaactgacagaaaaaattgtccgggtcatggaagaatgccggatgccgattgtgctggaaggtccggactgccactggatagataaagaaaatttcaagacagatccgtatgtgctgtacctttttgaggcaatgggagcatctgccaaaatattaaaaggctattcaccggacatccgcattaataaaatgtcgggggatatcctgccaacaaccgattatgccagaatccgggatgaactgggggctgattttgactgtctggagcatgaaggacatgttgtggaatttgttccgaaaggaacatcgaaagcgaccgggatagactggctctgcaggcatatgggtattaaaaatgaggatacctatgcgattggtgacagtgtcaatgatctggatatgctttcttttgtgggacatggaattgccatggggaatggaacacctccggcaaaagaggcggctgaatttgtgacaacggatatctacgatgatggaataaagcatgcaatggaacactatggattaatatagagtctgaatcgaggcagaaatgaaaaaaagaattacagagtaccggaaacgtgtggacaggcttctggcagacgaagaagagaaaacatatgaggaatgggaatgtattttggaagaacatctggttcagattggatttttccagcacgaacgtctgattcatctgattgtaacggttacatttgctgtgataacggtactgtcgttgtttgccccgctattgacggggatcatgacactctatggttttaccatgctgctccttgtgcttcttgtgccgtatatttttcattattatacacttgaaaacgaaacacaaaaaatgtatgcacagtacgatgaaataataaagcatacaaagaaagtgaattccgggaatctaaaaaaaatataaaaattgagtatcactgttgacaatgaaaaacaacagtgatattttatttacagaaagagttagcactcgaataaagtgagtgctagtaaaggcgaaaaggaggctatttgtaatgaaattagtgccattaacagacagagtagtattaaaacagttagaagcagaagagactaccgcatccggtatcgtattaccgggagcagcacaggagaagccacaggaagcagaagtaatcgctgtaggtcctggcggagtagtcgatggaaaagaaatcgttatgcaggtaaaagaaggccagaaagtaatctattccaaatatgcagggacagaagtaaaacttgatggggaagagtacattatcgtaagacagaatgatattcttgcaattgttgagtagtttttataaattggaaattataggctgaattttaaagaagagaggttattgtagtcatggcaaaagagattaaatatggttcagacgccagagcagcacttggtgcaggtgtcgataaattagcaaataccgttcgtgtaacattaggaccgaaaggacgtaacgttgtactggataaatcctttggtgctccactgatcacaaacgatggtgtaacaatcgcaaaagaagtggaacttgaggatgcatttgagaacatgggtgcacagcttgtaaaagaagttgcaaccaagaccaatgatgtagccggtgatggtacaactaccgctactgttttaacacaggctatggttcaggaaggtatgaagaacctggaagcaggagcaaatccgatcgtgttaagacgtggtatgaagaaggcaacagatgccgctgttgaggcattaaaggaaatgagccagaaggttaagggcaaagagcagatcgcaaaagttgcagcaatttctgccggtgatgaagctgttggtaatctggtagcagacgctatggaaaaggttacaaacgatggtgtcatcacaatcgaagagtccaagaccatgcagacagagcttgacctggtagaaggtatgcagtttgacagaggttacttatctgcttatatgtgcacagatatggataagatggaagcaaatctcgatgatccatacatcttgatcacagacaagaagatttccaatatccaggatatcctgccactgcttgagcagatcgtacagtccggtgcaagacttctgatcatcgctgaggatatcgagggagaagcactcaccacattgatcgtaaacaaactgcgtggtacattcaacgtagtagctgtcaaggctcctggatatggtgacagaagaaaggccatgcttgaggatatcgcaatccttaccggcggtcaggtgatcagctccgatcttggattagaactgaaagataccaccatggatatgcttggacgtgcaaaatccgttaaggttcagaaagagaacaccgttatcgtggatggtgccggagacaaggataagattcagggacgtatcaaacagatccgtggacagatcgaggagactacttctgagtttgataaagaaaagttacaggaaagacttgcaaagatggcaggtggtgtcgcagtcatccgtgtcggtgctgcaacagagaccgagatgaaagaagcaaagcttcgtatggaagatgcattaaatgctacccgtgcagcagtcgaggaaggtattatcgcaggtggcggatctgcatatatccatgcatccaagaaggttgcagagcttgctgattccttagagggagatgaaaagaccggtgcgaaggttatcttaaaggcactggaagctcctttgtattacatcgctgcaaacgcaggtcttgaaggtgctgttatcatcaataaggtaaaggaatctgcaccgggaaccggtttcaatgcagctaccgaagagtatgttgacatggtagaatccggaattcttgatccggttaaggttacaagaagtgccctgcagaatgcaacatccgttgcttctacattactcaccacagagtctgctgttgcaaacattaaggaagatactcctgcaatgccagccggtggtgctccgggaatgggcggaatgatgtaatcggacataaccgttgcgttatgaagtaaacatagtatcaaaaaccatgtgaaatagatatgaaaagccttgaaaatcaaggcttttcattttttttgtcctatgatatgatagaaagcgtaacggttcaaagacaaaggaaccgtttggaaaaacaacgaaaatcaggagtggaaaaaatgagtcgagtgattgttgtaacggacagtaacagtggtattacacaaagcgaggcaaaagaacttggcgtagtggtaatgccgatgcctttttatattaacggacagatgttttatgaagatattgacctgacacaggagcagttttatcagaaactcaaagagggcggagagatcaaaacctccatgccgctggttggagatgtgaccgataaatgggatgaacttttgaaagaatacgatgaaattgtatacataccgatgtcttcgggcttaagcagttcctgtgagacggcatatatgctttcccaggactatgacggaaaagtacaggtagtcaataaccagcgtatttccgtaacaatgcggcagtccgtgctcgatgccaaaatgctggcagagcagggaaaaggtgcagaagaaatcaaagagattctggaaaaagaaaaatttgaatcctccatatacattatggtcgatacactggagtatctgaaaaaaggcggacgtatcacaccggcagcagcagcactgggaaccttactgaaactgaaaccggtattgcagatccagggagaaaagctggatgcatttgcaaaggcacgtacggtaaaacaggcaaaaacaatcatgaccgaggctatgaaaaacgattttgagaagcgttttcacagcccggatggggagaagatgaatctggaactggcctatacatttgacactgcagccgctgaggcattcaaagaagaagtgcaggctgtctttccggacaatgagatcgtcatgcagccactgtcattatccattgcctgtcatatcggaccgggagcacttgcgatcgcatgttccaaaaagattgaagcgtagcaggcagcttttggaaactttcatatgctaacaaattaaagtttatgacttgtaatttcagtgggaatcctttataatcataaagtaaaaacggatgggtttttacacctgtccgttttcgtgcgtaaaaaagtgcgcacggaaagttaaagcagacatacaggaggaataaaagatggtaaaagcagttgttggcgctaactggggcgacgaaggcaaaggcaagattacggacatgcttgcaaagcaggccgatatcattgtacgttttcagggaggtgcgaacgcaggacacacaatcgtaaatgactacggaaagtttgcattacatacacttccgtccggagtattttacagtcatacaacgagtgtgattggaaatggtgtggcacttgatattccacgtcttttcaaggagattaagtccatcacagaccgcaacgttccgatgccaaagattcttgtgtccaaccgtgcacagattgtgatgccgtatcacgtactgtttgatcagtacgaggaggagcgtctgggaggaaaatctttcggatcgacaaaatctggtattgctccgttttattcagataaatacgcaaagatcggttttcaggtaagtgagcttttcgacgatgagctgttaaaggaaaaggtagtccgtgttgcagagcagaagaatgtaatcttagagcatctgtatcacaagccactgattgatactgatgaattattaaatacattacatgagtaccgcgatatggtagctccatatgtatgtgatgtttccttattcctggacaaggcactcaaagaaggaaagacggttctcttagaaggacagcttggaacattaaaagatccggatcacggaatttatccaatggttacctcatcttccacactggctgcatacggtgcaatcggggcaggagttccgccatatgagatcaaacagatcattaccgtatgtaaggcatattcttctgctgtaggtgccggtgcatttgtaagtgagatcttcggggatgaggcagatgaactccgccgccgtggtggagatggtggagagttcggtgcaaccaccggacgtccgagaagaatgggatggttcgactgtgtggccagcaaatatggctgccgtctgcagggaacaaccgatgtggcatttaccgtacttgatgtattaggatatctcgatgagattccggtatgtaccggatacgagatcaacggagaagtgacaaccgaattccctgtgaccagtctcttggagaaggcaaagccggtactcacaaagcttccgggatggaaatgtgacatccgcggtatcaagaagtatgaagaacttccggaaaattgccgcaagtacattgagtttatcgagggacagattggatatccgatcaccatggtttccaacggaccgggaagagatgatatcatttaccgtgagtcttctctgaacaagtaatcgaaacaagtaacagagcctgtaaaaagcagcgaatcgaatctgatccggtttgctgcttttagagtataagaaagcctatgcagatagaagtaataattgaaaaaaaatcacataaacttgatgcagaagaaggaaaaaccattttagagacacttcaggaacatggaatccatgtgctgacagcgccatgcggcggcaggggaagatgcggaaagtgtaccgtagaggtggaacatatgggagaagtacttgcctgtatgacaaaagtaaccgatggtatgcgtatcacaattccgaaagtgcagcttcgcgcacagaagtctaaaattgcagaaaacggaacggtcacacattatccggcggatgacggagaagggctggatgcggcatgcgatatcggtactacgacggtggtctgccatctgattgatggaaagacaggagaaaagctggcaacggtcagtgaaccaagcgcacagagaagttttggtgcagatgtgctttcacgtattcaggcagccgaagcaggaaaactggaaatattaaaagaacagattatttttcagatcgcacagatgcttcggacactgcagaaaaaaacagggagaggggaacagattcatcgtcttgccgtggtgggaaatacggtaatgtgtcatctgttcgcgggaatttcgcctgtttccatcggggtgacgccgtttatgccgcaggaattctttggaaaagagtataccggagagcagctgggacttacggattgcagatcggtatacatagcaccggcggttgcaggatttgtcggaggagatattacgtcggatcttttggcagtgatgcagaagaaacccaaagataaagtgcttcttctggatattggaacgaacggagagatggcggtcggaaacgaagatcagatttattgctgtgccacggcggtcggatctgcatttgaaggtgcggagatggcgatgggaatgccggcagcggccggagcgatatcccatgtctggctcgaccagcgaagaatccgggtgcaggtaatcggagacgaggaggcgtgtggtatttgcggttccggtctgattgatgcacttgcggtaattttagagatggggcttctcgatcacacaggattgttaaagcagaaacagtcggtttcggttgcctatcggaaatacttgggagaatatgccggacagccatgtgtctggctggcacataaggtatgtgtgacgcaggaagatatccggggactacagcttgcaaaggcagcatttgcagccggaatgcggattctgctgcaggatagccacactccgtatgaacagctggatcatgtcgttcttgctggtggttttggcagctatctgaaaaaagaatcggcagcggcgattggactgattccaaaggaattacttccgattacggagtcggttggaaacgcggccggagaaggtgcggtatccgcagctatttcccaaaaagcaagagagcagctttccataattcagaaaagtatgcattatatagagctgtctacccatccggatttttcgcaggaatatatggatcagatggattttgacgaaagtaagcgatagaaagggaaaaaatgatagaactgattgaggtattaaaagccgttttatttggaattgtggaaggcgtgaccgagtggcttcccattagcagtaccggacacctgattctgctgaacgaagtggtcaaactaaaggtaagtgatgaattttacagcatgtttgaggtcgtaatccagctgggggcgattcttgcagtcgttgttttattctggagtcagatctggccgtttggaagaaaaaataacgtggcacctttggcaaaacggggaccgggcgcatggataaaaacagatatttttaaattgtggtttcatattctggtttctgtcattccggcagcggtgattggtattctcgcggatgactgggtggagaaacatttttacaattaccagatggtatctgtcatgctgattctgtttggtattgcgtttattctgattgagaattcccataaagggaaaaatgtcagaatccatacgcttgcggatatcggttatgatacggcactttttatcggcctgtttcagctgatcgctgcgatctttccgggaacctcccggtccggtgcaacgattgtcggagcacttttgatcggggtgtccagaactgttgcggcagagtatacgtttttccttgccattccggttatgtttggtgccagtatcctaaagattgcaaagtttggactggatttttcgacatctgaggtcattatcctgtttgtgggatgtgtcattgcatttgtggtttccctgatcgttatccgttttctgatgggatatattaaaaaacatgatttcaaggtgtttggatattaccggatcattcttggcatttttgtgctggcgtgtggatttttaggagcattacatgcttaaactatatatccggccggtctgtttccagtgtccggaagaagaggagaattcgctgtctcttcttgtggagagccgcagggagaaagtaagaacaataaaaggaaaagaaaaccgcagcagatccattgcggcgggtcttctgctccggcatatgctgctggaagaacagatcccttatgccgaagaatcttttgggctggaaggacatggaaagccgcgtctgaaaaaagatggggttttctttaatttaagccatgcgggagcatacgcagtgggagcactgtcggatgtcccggtaggtgtggatgtggaacagcagaaccgtttttggcaggaagcccgcaaccggaaacttgcaaagcggatattaacggaagcggaatggaactggtggaaagatgccggggatgatccgcaggaactgctccggttctggacaagaaaagaaagctatgtgaaaatgaccggggaaggaatgacaaaggcatttcataccgtggataccctgcatgggaaatactataaagaaattccgctgggaaccataaaagacagatatctgatcagtgtctgtacgcaggaagataggacttgcgattttgtatgtaaaatgttagattaatatctggaggcagaatatgcatgatgaattaacaaaaaaggatattgaaaaaatggaggcagagatcgagcaccggaagctggtggttcggaaggaagccctcgaagatgtaaaagaagcacgtgcccagggagacctgagcgaaaattttgaatataaggcagccaaaaagtttaaaaacgaaaatgaaagccgtattcgttatctggaaaaaatgatcaagacagcagtgattgtttctgaagactctccggaagatgaagttggaatgaacaataccgtcgatatttattttgaagaggacgatgtgacggaaacatataaactggtgacaacagtcagaagcaattcactgaaaaatctgatcagccgggaatcaccgcttggcgcagctattttcgggcataaagccggagatcgctgtgaagttcatgtaaatgataattattcctattttgtacagattaagcgtattgtcaatactgtggatgacggcacagatgagcttcgaaaattttaacaacaggagacaaaaataaaatgaaagtatcggaaattttaaagaagaatgaggtgaccatctcatgtgagattttcccgccaaaacagggagcacagctgcagaattataaggcaattgcagcagaaatcgcaaaattaaaaccggcgtatatcagctgtacgtatggtgcgactggcggaacaagcgattatacggtggagatcgcagatgcgatcaattcctacggagtaccggcgattgcacatctgacctgtgtttcttccactagggagaaggtacataccgtaatcagcgaactcaaagagcgtggaattgaaaatattctcgcactccgcggagatatcccgaccaatacagatttcccacttccggatcagtatcaccatgcgattgagctcatccgtgagatcagggaagccggtgatttctgcatcggtggtgcatgctatccggagggacatccggaggcttccaacatgaatgaggacttggatcatctgaaagagaaagtggatgcaggctgtgagtatctgaccacacagatgtttttcgacaataatatttactaccgctttttatacaaggcacttgcaaaggggattgatgtgccggtcacagcaggaatcatgccagtgaccaatgctgcacaggtaaagcggacaatttccctgacaggaaacctcgttccagccaaatttttgagtattgtggatcgtttcggggacaaccctgcagctatgaagcaggcaggaatcgcctatgcaaccgagcagatcattgatctgattgccaatggtgtaaatcatatccatatctattcgatgaacaagccggatgttgctgcggcaatcatgaataatctgtcacagatttatgtaagagagtaggcggttctatgaaaaaaaaggaagaacagctgatccgtaaagtgacggatatgatccagaagacacgggaaggaaaactgcactgggatatccagtgccagaccaccgagtacaatgatccttcgaccaaaccggtggagacagaaaatggggagacctgggtgattgatgaatgttttgtttcctatcactgtatggatcaggagaaagaatttctgctggtttcttatgagcagatttatacctgcggagaaaaaaagaagtcctgcaatttaattttccagccaccgcttggcatacggttttttgatgtagatgttctggcaccgtatgcggtggaagcggatcagatgctgatatatgaagtacatatgttgtggctgaccgtgctggagcagtacaagaaggagccgcagaacatcgagctggatgtgacagggcgcgagctggtactgcagcaataaacatgaatatacaatgtgtataataagttaaaaaaacctctggaatttttagacaaaatttccagaggttttttggcagtttttccaactttatttcgtatacattttcaagtataatgaaaaacgaaaaaaaccgaaatatcattcaaaaggaggaaaaaatgggagagagaaggttttcaacaaagaaccgttttgtaagttttttacttgcaattgcgatggttctgacacttttaccgattggggcggtacaggcaaaagcagaaggcagcagacaaattattatgcacttcgaaaattctacaaattgggaggctgtttatacgcaaatagccgaaggagataatagctggaaggatattgatggctatggttatgcaaatggctggccaggagctgaagtagaacaagattcagcaaatgacggctggtatagctttacaattagcacaaattcagatgagaaattccattgtatatttaacaataatggaaaaggaaaacaaacagataatattgaatttacggcaaatgattctaaagtagaaaagtggattactggcgaaaaagggaaaacggtaaccagtgatcagaaaccggaagggtggaaggaatctacaagcagcgcaccagtaaaaccggttataaaagtacagagtccagttgtaaatgaggatcgtaccgttacatttaatttggatgcaacaggcgaatataaagatgcaaaagatgttcggcttatgggaactgtcggaggaacggactgggataatggattatcaatggaaaaggaaggggataaatttaccgtaacagttcaaaaacaaaaccctggaatatatgcgtataagtataaaattgggacgaactggttcaaagaccctgcaaatgatgccgtgacagacggcaatagtagattagtagttccggggcttgaatcaaaaaatctggaagctgtagcaggtaaggacttagaacttcctaaaacattaaaattatatagcagtgatggaacaagcagtgatgaaaaagtttcatatacattaaaagattctcctttaaaggataaggttacattgacagatgaaacaatcaatgtgaaaaaaggcagtggaataacaactgttgagttaaccgcaactgctggtaatgaaacgtcagatgttattgttaatgttgtggaaaaacagtataaagtaacaattaatatgtattctccagattttgaaatgaaagctggagtatccgatgtatatatatatgataaaaatggtagtggaaaagagtttgttcccttaaacgaaacagaagaagactcggcgaacaatgtgacctggttacaggggacggttttagtttcgtttaattcgcttgggattattggaagaccaacggcggggtcatgggatggacaggatagtaatcagtattatgttattgatgaggaaaaatcagaaataaccttatggtatgtgtttgggaaaaaaccggttacagaaaaaccggtcattaccaaagcagatccaaggtatctgtgtctggaatacgaaaatgatactttgacaaccactccggagttttattcatggactactggtattgaagagaaagtacgcaaaccatttgaatctgcaggagcaggaaaatggaagatcaaagttcctgttaaatcaacttgtacgaaggttgatttcgtggttgtgctggatccttccggctctgactggatcaaggatggaggagatcactccattgcattcccacaagaacagaacgttgtatgcgcaagcatgaaaaaaggggaagaacctgtattgagtgctccatacaataagggatatgaagtccttccaaaagaaaataagattgcattttattatcgggatgataacgccttaattgatgataagcttgcagatatgaaggtatctgtagatatcaatggtacggaatatgaaatgacttataatgctgggaataagcgttttgagtataactataacaaactggaaagcggacgtacatattatcgttataaagtcggggatgaatatattttagacaaatataacgataagcaggaacaaaaagagggaaacgattattcttatattgagtattataaactgaatgccactattcaggcagaggtaatgaatgcgtcatttaattataatgagaataatgtcgtaaaatttactgtaaatcaggatgagaatgagacaaagaatgagacaaagaagatggaagttgcatctgcaagtattgatgtttcttctttaggtggaagcagtacattggcaattgtaccggatttgcaggcggtaacaatatcagccacaacagatacttcgctaggtaagaaaacattgccaattgttgtaacagatcagtatggaaatgagtattcaacaagtgtacaggttgaagtgactgctcgaaccaggaaaaatgcgaaagattttgattgggatgaatccgttatttattttatggtaacggaccgcttctttgatggaaatgaatcaaacaatacagcaagcggagcacagacttacggaaaggataatgcaggtctgtatcatggtggtgatttcgcaggaattacacaaaagttagactatttagaggatttgggaattaatacaatctggattactcctattgtagaaaatattccgggagttacggtaactgacacgggaaaagaagatgttccgtacaatgctgcataccatggatattgggcaagcgattttacaaaactgaacccaacgcttggaacaaaagaagaattccagacattgatcgatcaggcacataaccgcggtattcgtattatggtagatattgtggttaaccatgccggatatgatacaaagtttggcgatatgatccggagtgaggacgatgttgtatccggaagtgaccagaaggattccttaagtgatttgccggattttaaaacagaagaccctgcggtcagcgcgcagcttgtaaagtggcagacccagtgggtaaaggattttggcatcgactatttccgtgttgatacagttaaacatgtggaaaacgatacttgggcagaattaaaaaatgctctgacggaagtagattcagattttaagatgattggagagtatgcaggaggaggctatgcttctaatggcaatactttaggaaccggagaaatggattcggatctggattttgattttaatgatcaggcagctaattttgtaaaaggaaatatttcttctgtagaaaatttcctggcatccagaaacagtgcgttaaataatacttacatgacaggacagtttcttggaagtcatgatgaagatggatttaagcagaaacttttggatggtggaatgaaagaagatgcagcaactgcagcgtctatggttgcagcaagcttacaaattactgcaaagggacagccagtgatttattatggtgaggaaatcggacagacaggattaaataattatccatatcagacaaatcgttatgattttgactggtcaatagtaagtaatgacaataagacatatcagcattataagaagatgctttctatccgtaatgcatatacagatgtatttgcaagaggagacagaaaaacaattttagcatctgatgaaaatggttatgatattgtatccagaagctacaaaggaacaaaattatatgttggtttaaatatcaaagatgttgcacagactgtagaaattccagttagtgaaaataatggaactgttttgaaggatctgtattctggaaaaacatatacggtaagtaacggaaagattaaagtgatcattccagcggcaacagatggtggtaccgttgttctgaaaaataattcaagtacaaacggcggatctaccggtggaagttcctccagcggaagcacaacaaccgaaaccaagccttctgaagataccaaaaaggatacaacaacgacagagattgttattcctgcagaaaaacttccggaaggaacgactgcaaccgtaacagtcacaaaggatgcaagcggaaaagtaaccgcagaggcagcagtagcagcaactggaaagacaagcaaaacaggcgtgaaagcaaccgtaaatgccgatgtgatccaagctgtaacagaagctgccggaacgaaagacgtaaccatcacacaggaagtcaagaaagcagatggaaccactgcatacaccgtacaggtaaatgcagcagacgtcaaagcaggtgcaaaacttgcagtcatgaagaaagacgaaaagaccggagaactggttcttgtgaataagaaatcgtataaggttacaaaggacggttccgtatcactgactttcaaagaccgtggcgtatacgtcttaaagacacaggcagaagttaaggcagctgcaaagcagattgcaaagactatcgcacctgcaaagagcacagtcaatattggtgtaaaaaagacaaccgtattccagtggagcaagaaactgaatatggaaaacgttgcaaagattacctataagtcttccaagaagtctgtggtttccgtaaataaaaacggaaagattacaggaaagaagaagggaaccggaaaagtaacggtaaccgttaccttaaaagatggaacaaagaaaatcgtaaccattaaggtaactgtaaagtaagaaaatatcaataaattactcattatctgctatcggggcttatggagggagaacctctgtaagccctgatttttattggactttcatgtgtcactgtgctatactcgtgatacattaaggaggaggcaaaatgaagaaatcatatgcagtgatcacaggggcaagctccggaatcggtatggcgtttgcacggcagcttgcagcagaggggtatcgtctggtgctggttgcacgcagagaggaccggctacaggaactggcgcaggaattacaaaagaagggaaccgagagcattgtgatatcggcagatttgtcacaaaaagaagcctgttatcacctgatgcagcagatcgagaagctgccagtcgggatattgattaacgatgcgggattcggtgactgtggcagctttctggagacggacgcagataaggaaatgcagatgattgatgtaaatgttaaggctatgcatcttcttatgaagctgatgcttcgccgtatggagaagcaggagggcggttacatcttaaatgtggcttcctcggcgggacttcttccggcagggccttatatggccacctattatgcgaccaaagcttatatagccagcctgacacgtgccgtggcactcgaactgaaacagagaggcagccgcgtgtatgtgggggcattatgtcccggaccggtgaatacagaatttaatgccgttgcaaatgtagagtttgcactggcaggaattactccggaatattgtgttagatatgctttaaagcagatgaaaaggcgcaaagtagtgattgttcctacgttgacgctaaaagccgtgacaacctgtggaagatttataccacaaaaagtgctgattgcaattaccgcacatcagcagaaaaaaaagctcagagcagaggatatatcataagatggaagaaattaaaatcggttcccatgtgggaatggcaggaaaagagatgtttttagcgtccgtaaaggaggcagaaagctacggagcaaatgtgttgatgctctatacgggtgcaccacagaatacccgcagaaaagaaatcaaagatctgaatattgaggcaggatgggcctatgcaaaacaggccggaatccgggagattgtggttcatgcgccttatatcatcaatctggcaaataccgtaaagccggagacatttgaactggctgtacagtttctggaaaaggagatccggcgcacggctgctatgcgaagtcatatcctggtgttacatccggggtccgcgctggatgcgggtgcagaggccggaattgcacagactgtccgcgggctgaatatggtgctggatgagaacgaggatgaggtatttattgctctggaaacgatggcaggaaagggcagtgagattggaagaacctttgaagaaattaaggcaatctatgatggagtgaacaaaaaggagcggttgagagtctgttttgatacctgtcatgtaaacgatgccgggtatgatctggtgcatgattacgatggtgtttttaaacattttgatcaggtgatcggactcgaccagattgcggtctttcatatcaatgacagtttaaatccacttggggcacacaaagaccgtcatgccaatatcgggcagggaaccattggatttgagacgttgcatcgtctggttcatgatccacgttttatggaaattccaaagattttggaaacgccatggctttgtgcagagggggagacaaaaaagacgattcctccatataaagaagaaattcaacagcttcttgcaaaataatgacaaaaaggagaatggttatggaaacaaaacaaccggggatttccggctattggttaaagctgattgctgtaatttccatgctcattgatcacacgtcagccgttattttagaacagattccgggactggaaaatcccgcatttttgatgcgcatcattggaagactggcgtttccgatttactgttttcttctggtagaaggattttaccatacacgcagcagggcaaaatatgcggggaggctttttttgtttgccctgatttccgaggttccgtttgacctggcattcagcaggagaatgtgggatttttccagcaacaatgtcttttttactttgctgttcggacttttggtgatctggggtgttgaagggataaaacagaagtttgtggaggaagtttacgggaataaggccgcagtcatccgcctgattcttaccattgtgacagttgcagccgggggatttctggcacttcttttccgtacagattacgatttgtcgggaattgtgacaatttttgcaatttacatgttttatccgaagaaagtgaagggaatgggtatcggtgtttttgttttaaccctgctggcaagtatcattgaagcggcagcatttctggatatgataccggtttatttttacaatggaaccaggggaaaacagatgaaatatttcttttatatattctatccggcacacctgtttcttcttgccatgatcgcacgggcaatgggactttgggcttaatattttaagaagatgttacgattcttatgaaattcttatctttttcagatacagcttgcgttcctgaaaaagcgggagtacaatgcagacgaaatgaaagacagataggaatggaggtcttggatgatgagacaaaaatcttggaatcagtttaaaaaaacaatggctgcctcgacactggcaggagcgatcacttttacagggtgtgcggtgatgccttcggttacagcttttgcagatacaacagaacagaccggtcaggtatcgtatgataatgaggtgatgccgatccacacggacgtgaagacggaggcaaaaccgttgatgaagggtacgtcatgtacggtttcggatggaaagaacctgtattatgcgtttgaaatgatgggtgtgcgtatgggcattatgaaatacaacaccaaaacaggcaaaaagagtgaggtatattcctacaaaatagggaaaaacaaaaagggaagcaatggtttttcccaattatctgtggataagaaatatatttatgcaacctgggaccgttactatggaaccgatgcaacaaaagaatatatttaccggatcgcaaaagacgggaaatccgcaaagaaacttgcgctcggacgtgatccacagcttgtagatggacggatttattatctggcactgaaaagtaaaagtgaagatggcatgaattattcggaagataccggaaccgttatgagtatgaagacggacggaacggataaaaagaaagttgcacagattgtaaacagcggagatgcttatcggtattccctgtttcagagtgagggaaagatttactataccaaggaaaacgagaacaagacattttatgatctggagggaaacagttatcagagagaggcctttgcggttaaggatgaaaattatctgagtgtttcgctggaagccgtcaatgatggaacgtatacctaccgtacgacaggaaaggatcggtacatgcagacgaaactctaccggacagataacaggacgggaaagaaaaaccttgtggcatcctttaaacttggcattgaaaaatactcggtttgtggaaattatgtattcgtggaagcaaatgttccgtacaagggagctgatgtgactgagaaacttgcagtttactgctataaggcagatggcagcagcaaagtaaagcttgcttcctggtttccggcagaataaaatccgggtaacaatcgaaaaaataaaagaagcaccgcgactgcggtgcttcttttattctggggatttatttatccagatcttttttatctacattctgcagcatcattgcacgaactttcagaggaagtccgaacagtgtgatgaatccgtctgcatcgtgatgatcgtactgatcaccggttgtgaaacttgccagagactcactgtagagagagtatggagaagttgtgccggctttgatgatgtttcctttgtagagcttgaattttacttcaccggtgacatacttctgggtagaagtaacaaatgcctggattgcttcgcgaagaggagtgaaccattttccttcgtatacaacattggcaagacggttgcccatctctttctttgcagataaggtatcgcggtcgagaaccagttcttccagctggtcatgtgcttccataaggattgttccgccaggagtctcatatacaccacgggatttcataccaacgacacggttttctacgatatcgatgatgccgacaccgtgctttccaccgagacggtttaattcacggatgatatcggaaactttcatttcttttccgtttacagtttttggaacacccttttcaaaggtcatggttacatattcgccttcgtccggagctttctcaggggaaacaccaagaaccagaagatgatcataatttggctcgtttgcaggattctccagctcaagtccttcatggctgatatgccataagttacggtcacggctgtaactctggtctgtgccgaatggaagatcgattccgtgtgctttgcagtatgcgatctctgcctcacgggaatccatctgccacttgtcatcacgccaaggagcaatgattttgatatccggagcaagtgctttgataccaagctcgaaacggatctggtcatttccttttccggtagcaccgtggcagattgcaacagcgttttcttttctggcgatctctaccagtttctttgcgataccaggacgtgccatggcagtacctaataagtatttgtgctcatatacagcaccagcctgtacacaaggtacgatgtaatcgtcacagaactcatctgtgatatcttcgatatataatttagaagcgccggataatttggctctttcttccagtccgtctaattcttcgccctgtccgcagttgatacagcagcagacaacctcataaccataagtctcctttaaccaagggataatagcggtagtatcgagtccgccggagtaagctaaaacaactttttctttcataagattgtatcctttctttctatatggaattgtacgctctcgtacgactaaccctactatacatcaatccaaatgaaaacacaagtgaaaaaatatacataaaattgcataaatatacataaatttgtgaatatttgctatttacggatggaaaaagatggactattatagggtagaatcatatttttaaaagaaagaaaaggtaagaaacatggtaaaggtaggaattatcggagcgaccggttatgcaggagcagaactggtgcgtattttattgaatcataaagaggcacagatcgaatggtttggatcaagaagctatatcgatgaaaattatgcagatatttacagaaacttttttgaacttgtcgatgcagactgtctgggtgataacatggatgagcttgcttcccgcgtggatgtgattttcacggcaacaccacagggatttctggcaggtgtgctgaatgaggatattttaaataaggtaaagatcattgatctgagtgcggattttcgaatcaaagatgttgctacctatgaaaaatggtataagattgagcataaaagcccacagtttattaaggaagccgtttatggactctgtgagattaaccgtgataaggtgaccacccagacccgtctgattgcaaatccgggatgttatacgacctgttccattctgacagcatatccgctggtaaaagagggactgattgatccggatacattgattattgatgcaaaatccggtacttccggagcgggacgtggggcaaagacaccgaacctgttctgcgaagtgaacgagagcatgaaagcatacggtgtgacaacacacagacatacaccggagattgaggagcagctcggttatgcggcaggaaaagagattacagtgaattttacaccgcatctggttccgatgaaccgcggaattcttgcgacagagtatgcaaccctgatcaaaaagccggatggtacctatccttcttatgaggaactgaaggctgcttacgataaatattatgcaaaggaacgtttcgtgcgtgtattaaagaaaggtgtctgcccggagaccaagtgggtagagggcagcaattacgtggacgtaaactttgtcattgatgagcgtaccggcagagttgtgatgatgggtgcactggacaatctggtcaagggtgcagccggacaggccgtacagaacatgaatctgctgttcggatttgatgaggcagaaggactttccatggttccgatgtttccataatgaaatgcatctgtttgatgcatttcctacgctcattgtttccgcgtaagaggaactttcatacaatgagctctataatgaggtgaataatgagtaaagaatatacaatccgtgtgatgacactggaagattatgatgaggtgtatgcgttgtggatgggcatccacggttttggaatccgttccatcgatgattccaaagaaggagtggagcggtttttaaaaagaaatccgaccacgagtatggtagcggtagcagatggaaagatcgtgggagccattctctgcggacatgacgggagacgcggatgtctgtatcatgtctgtgtgcatgaagattaccggaagaacggaatcggaaaagccatggcagtcgcatgtatgcgcgccctgcagaaagaaaaaatcaataaggtcagcctgatcgcatttaagagcaatgagctgggaaatcatttctggaaagatgccggctggtgtttccgggaagacttaaactattacgattttacattgaacgaagcaaatattacgagatttaatcagtaaggagaatgttatgagtgagaatttaaacgcattggaaaaagcacaggtgctgattgaggcattgccttatatccagcgttttaaccgcaagattatcgttgtaaaatacggtggatcagcgatggtagatgagaaactgaaaaaacaggtcatccaggatgtcaccctgttaaagctggttggattcaaaccgatcattgtgcatggcggtggcaaggagatcagcaaatgggttgccaaagcaggaatggaaccggaatttatcaatggactgcgtaagacggatgcgcctaccatggagattgcagagatggtgttaaaccgtgtcaataaatcacttgtatccatggtgcaggaacttggggtgcaggcggtcggcatcagtggaaaagacggtggtctgttaaaggtggaaaagaaattgtcggatggtcaggacatcggatatgtaggagaagtaaaggaagtgaatccaaagattctgtatgatctgctggagaaggatttccttccgattatctgcccgatcggtcttgatgacaattatgatacatataatatcaatgcggatgatgcggcatgtgcgattgcccgtgcggtttccgcagagaaactggcattcttaaccgatatcgagggagtatacaaagatccggaagatccgtccactctgatttccgaacttacggtttccgatgcaagaaaactgattacagacggatatatcggcggcggtatgcttccgaagctgaataactgcattgacgctattgaaaacggagtatcccgtgtgcatattctcgatggaagaatcgcacattgtctgcttttggaaatcttcaccaatcgcggaatcggtactgcaattttgggtgatgaagaacatcatttttacaatgaataagagataagaggtgtggataaacaatgaataaacaggaatatattgataccgcggagcaggaactgctgcatacctacaatcgtttttcacttgtactggatcatggtgagggcgtatacctttacgatacagacaaaaaagcgtatctggatttcgcagccggaatcgccgtatgtgcgctgggctatagcaatgaggcgtataaaaatgcgctgaaggatcaggtggataaactgctgcatacgtcaaatctttattacaatgtcccgaccattgaggcggcaaagaaagcactaaaagccagcggaatggatcgtattttctttacaaacagcggtacggaggccattgagggagccatcaaagctgcaaaaaaatatgcatataccagagacggacatgccggccatgaaatcattgccatgaaacattctttccacggaagaagtatcggagcactttccgtaaccggaaatgcccattatcaggaaccgtttgctccgctcatgccgggtgtgaaatttgcagagtataacaatttagaaagtgtaaaagaactggtaacggacaagacctgtgcggttattatggagacggtacagggagaaggcggaatttatccggccgatccggcatttatcgagggcgtgcgcaggctctgtgatgaaaaggatattctgttaatcttagatgagatccagtgtggcatgggacgtaccggcgagatgttcgcatggcagaattatggagtaaaaccggatatcatgacctgtgcaaaagcactcggatgtggagtgccggtcggtgcatttttcctgacacagcgtgtggcagacaaatcgctggcaccgggagaccacggaacgacctatggtggaaacccatttgtcggagcagccgtttcggcagtatttgatcagtttaaagcctgtgacattttaggtcatgtaaaggaagtagcgccttatctggaacagaaactggatgagctggtagaaaaatatgacttccttgtaacacgcagaggcaaaggtctgatgcagggtgtggtttgcaagcttccagttggaaaagtggcagccgcagcacttgagcagggactgatcgtgatcacagcgggagcggatgtccttcgttttgttccaccgcttgtcatcgaaaaacagcatgtggatgaaatgattgaaaagctggaaaaagcattactttctgtgcaggaataacttacacttgtaaaagtaacaaaaaatcgttaaaatagaaatgcattgagactcgtttcgccccggaaagggagaaatgagatgaaaaaacattggataaaaaagtgctgtatgattctgacatgcctgtatctgacgggatgtggcagggaggaagtgccatatctggataccacgcagacacaggagcagacggtggaaacggaacgaacggaacaaaaagaaacattaaaatccgaccagacggtacaggtatatgtatgcggggaggtagcagctcccggtgtctatcagctgaaagacggtatgcgcatctgcgatgcggtggaggcggcaggaggactgaccaaagttgccagccgcgaatactggaatcttgccgagaagctttcggacggacagatgatttattttcccacagaggaagaggcaagggagcggaaagcatctgcagaggcagccggtgcctctgtgcaggaggaatcggacgggcggatcgatatcaatacggcggatgccgcgcagcttgtgaccattccgggaatcggagagacacgggcggcggcaattcttgcataccgggagaaaaacgggccgtttgcgaaagtcgaagatatcatgcaggtatccggaatcaaaagcgcactttttgagaaaatgaaagattatataacgattcgttgaggtgtaatatggcaaagaaagttctcgtagtagatgatgagaaattaatcgtaaaaggaatccggttcagtcttgaacaggacgggatggaagtggattgtgcatacgatggagaagaagcgctgaatatggcgaaagcaaatgagtatgatatgatccttttggacatcatgcttccgaagatggacggattcgaagtatgtcaggcgattcgtgaattttctgatatgccgattgttatgctgacagcgaagggcgacgatatggataagattctgggactcgattatggtgccgatgactatatcacaaagccgtttaatattcttgaggtgaaagcgcgtatcaaagcgatcatgcgtcgtaccgcaggaccgagagaaaagaaagaagtttcttcgattgtggagaaaggggatctgcgtctggactgtgacagcagacggctgtttatttcaggcagggaagtaaaccttaccgcaaaagaatttgatctgctggaacttcttgtgaaaaatgaaaataaagtatacagcagggaaaatctgctcggactggtctggggaaaagattatccgggagacgtgcgtacagtggatgtgcatgtacgtcgtctgcgtgaaaagatcgaaaccaacccaagtgaaccgaaatacgtgcacacaaaatggggtgtgggatattattattaccagaaatagacgagaaggcagaaaggtttttccatgcagaagagtaaacagtttcttcagttcttaaaaagtttaaaatttcggctgattcttttgatcgttgtgatcgcggtcgtaccgagtctgattctttcggcagcagttttaaaatattacgaaaagcgtgccgtttctatccgggaaagtgaaatcttaagccaggcaaaaattctggcaaatcagatagcgacaagtgaatatatgaagctgggggcagatgtatcgtccagcaatattcagacacagattgatatgctcacgaccatctatgatggtcgtgtcattgttgtggatgacaactgcaaagtttattatgacacgtataatctcgatgaccataagctgatcattgcagaggaggtcatgcgcagtttcaagggcgaggatattgtgcattatgattcggagaaccattacattgagatgacgatcccgatcagcgatcctgatgataaaagtcaaacggtgatcggagttatgctgatcagtgtttctacggacaatattgtgatcaaccagtcatatatgcgacaggtggcggtgatcgttatggtcatggtcggaattgcaattgtgttttttgcaatccttctgcttttgtatttcctgaagccgttgcagaagattgaagagggaatcgctgcaatcaaaaacggatacggagagtacaatcttcaggtcaatgattacacggagacggcgggaatctgtgagaagatcaatcagatgcttggccggatcaaagtcatggatgattcccggcaggagtttgtatcgaatgtgtcacatgaattaaagacaccgctgacatccatgaaggtgctggcggattcgatcaatagcatgccggatgcgccgaaggaactgtatcaggaatttatggaagatatcaccaacgagattgagcgtgagacaaagatcatcaacgatctgctttctctggtgaagatggataagtctgcagcagggctgaatgtatcttccgtcaatatcaatgaacttttagagcagattttaaaacgtctgcagccgattgcggataagcagaaagtggaacttgtccttgagagtttccgcccggttaccgcagaagtggatgaggtaaaaatcacgcttgcgatcacaaatcttgtggagaatgcaatcaaatataaccggaatgacggagagggctgggtacacgtatcgctgaatgcggatcaccagtatttctacctgaaagtagaagattccggaatcggtattccggaggagtctctggatcatatttacgaacgattttaccgggtggataaatcccattcccgtgagatcggaggaaccggactgggacttgcgattacaagaaattccatactgatgcatcgcggcgcaattaaagtacattctgtgatgggcgagggaacaacctttgatgttcgtattccgctcaactatattgcataggaggaaaaagatgagaaaaaaaataatttcaatcatactccttgtggcaatggtactcacaatggctgccggatgtggaaaaaaagaagataaaaaagactattttgtattttatgtaaacaatgagctgacaaaggttgttgcgaaaaagattaccctgcagcatacttcatccggcaaagtacaggtgaaggaactgctcaaagatctgcagacacagccggaggatgcaacgcttcgaagaaccattccacgcaaagtaaaaatccagaatatagatctgatctcttatcagattacggtggatttcagcaaggaatattacgatatgaaaccgacggaagagattctgaccagggctgcaattgcaaagacactgttgcagctgagccagtatgtgacctttactgtggatggaaaaccacttgtggatgcctcgggagcaaatgtaggtgccatgaatctggacagttttgtggaaaatccgggagaacagatcaattccagccagaaagcaacactgaaactttatttttcaaataaggcgggtaccagactggttccggaaaccagagaggtacattacagttccaacatttcactggaaaaactggtgatggaacagctgattgagggaccaagaaaaagcggactcttggcaacgattccttcggagacgaaactgattacgatcacagtggtggatggggtctgctatgtcaatctggatgaaatgtttttgaatcagaatcaggaaatctcagaacctgttgttttatactctatcgtggattccctgacggaactgacgggaatcgataaagtacagatttccatcaacggagacaccagcggcaaatgccgttacacgtataaactatcaaagatgtacaaggcggatgaccggctggtcacaaaagaaagcgatgagaaagtagaatctacggaataggaaaagaaagcgtgaggaaaagaccatttcttttgcttgccacagagtttctgctggggattgtgtgtgtcagagagcagctgccggcatggggtgtgctggcagttctgttactggtatataccactccatggaaggaacgggggatgcggaaagttctgtttgcggcaggacttcccggtatgtttctttttgggatgctgcagatgcagcgacagatcgatttcaggcagcagtacctgcagaaactcacagatggccaggaggttcgcctggcgggaaagattgatcggatagaaccgaaaaccagatgcgtttattactatttaaaagattgcacggtggaagcagaatcgcagacactgccatgcaatgatgtaatcgcatatgtttcttctgccagccattcggctggacaaatcctgaatattgagggtacaatttcattatttacagaagcatccaatgaagggatgtttgatgcccggcagttttaccagagtcagaaaattgatttcggcatatgggtcacaaagatcagccgggtctatggaaaaccggatcgttaccggtgcgcactacagaatatgaaaaagcgtgcaaatgacgtgatccggcattctatccgggacgatggcgtgctttctgcgatgctgttaggggaaaagggggctctggatgcagagataaaatctttgtatcagagagcggggatcgcccatgtgcttgctatttccggacttcatatttcccttctggggatgggactgtaccgcctgctgcggaaacgactgcatacccggtatgtgacagcagcgctggcaacgaccgtttttttgatttcctatgcggttttaagcggaaacggggtatctacacagcgggcggtgggcatgtgtctgatttatttgtttgcggatgtgacaggatatgcctatgacatgttaaatgcgcttggaattgttgtgctcgtacttttgtgggaaaatccgtttctgctatcgtattccggatttgtgttttccgtgatggcggtgattgccatcggagtgggagccaatgtactgctggaatgggaacattcatggaaatgcagacagcaggccggagaggaaaccatcaaaaaaacatttttctcaagacaaaaagaaggaattctggtaagttttgcaatccagttgtttaccatcccgctggtcgcatattcttattatgaaattcccgtgtacgcgatgctgataaacctgtttgtacttgcggtggtcaacggattactggggcttactgtgcttggggtgattgtggggatggcgtttttgcctgcggggcgtgttctgtttgcgccctgtggctggatgctcgacagttaccggtttctgtgtgaggtttccttaaagattccgggtgcgcagaggatcacagggaaacctgcgcatatgcggatcttttggtattacctggggcttggagtgtttcttctggcgatctatgcctgtgcacgcagaaatgaaaagcataaagactgcagggaaacggcagatctgtgtgtaagccgaagaaagaaacgactgcagggcatagttttttcctgttttattgcgtttcttctgctttttcttctttttccacagaagaaatcgtttgagattgatttccttgatgtgggacagggagacggtatttatctgtgcacgggaggcgggacttccatgtttatcgatggtgggagcaccgatgtgaaacaggtgggaaagtaccggattctgccgtttttaaaggcaaaaggagtgtcagagatttcttactggtttgtcagtcatacggataccgatcatgtgtccggtcttaaggaggttcttgtgtccggataccgtgtggagtatctggtgtttgcaaaagcagtggaaaaagaagcaaagacaaaagaactggcagaactggcccgcagccatggaacgaaagtgctttatatgcaggcgggggatacggtaagaagcaaacgtgcagccatgcgctgtctgtatcccaaagcttcggataaagcggaggatgtcaatgatctgtgtctggtactgcaatttgaagagggggatatccgcgccctgtttggtggagatatctctacagatgtggaagagcagctgagccgccgcgaaaaatgggataaggttttgatttttaaggcggatcatcatggatcgcgctatgcgaacgcagaagcgttattgaagtgtatccggccggaaattacggttgcttcagccggaaaggataaccgttacggacatccgagcccggatgccgtacaaaggatcaaagagagcggcagcagatttttttgcaccatcgaaggtggacggatacgggtgcgcgtcatcgaaaataagctggtgtgcgaaacttatgtgaaatagagaaaattattttccggcactgtactgtaccagaaacagttcaacggccatctggtcattcatgtgtccggtttttactgcagtttcgtattccacaccatcgcggatcgcctgtttgagctgatccatggaaaaagcacggctctgcgactggtatttgcggactgcccactccgggcagccggcttttaaagcaatttctttgttgccaaatccctgattggtcatggatttgacaatcatcagacgctgaaactggctggaaagcagaaaaagaatacgcatcggagcttctttgagagcaagaagatcataataaagatccagtgcctttttctgctggtgcagtgccactgcgtcaatcatgtcaaagattttattctcggtctgttcggtggtgatggcttccacatcagagatatcaatatagtctttttccagtgtgtagcagagaagtttttccagctctttgtcgatattttccatgtcatcaccggttttacggataaagagcgcataggcatctcttgtaatattttttccgtttctgcggattcttccctcgatccagcgggagagagtcgtctcattctgacgcggaaattccacgatgcttccgttttttttcacctgcttgtacatctttgttttcttgtctatttctttttccgcaaagacaaaataagtggtttccggaatggaagacatgtaatcagcaagttcttcggcgctttttttaaacagaccgctgtcttcgatcagaatgagtctgcggtcggcaaaaaaaggcagtgtctctgccagatcgatgatctctttctggttgatgtcgctgccggagaaagcagaaaagttcatggtatcatcatccgctgccagtgcatgctttaatttgtcccggtactggcggatcagatactgttcttctccgtataacagataaatctgtttgaattgtcctgttttgatgtcgttatcaatcgttttcatgtctacattatatacatattggcagacttttacaactttttttcaattacatcttgacagaagggacagcttgacatattatattctagtatgtttgcgatgaagcgtccgtgtctgtttcaccgcaggaaacaaattacagtttgatatggaggtgtacagattggctaacattaaatctgctaagaagagaattttagttacagagacaaagactgcaagaaataaagcaatccgttctgaagttaagacttcaatcaagaaggtagaggctgctgttgctgcaaaggataaggctgctgcagaggctgcatataaggatgcttcttcagttatcgagagtgcctgctctaagggtgtatatcacaagaacaacgcagctcgtaaagtttcccgtttagcaaaattagtaaacggaatcgcttaagatctgaatattataaaagaagaaggactgccagtaccgtcatgctggcagtcttttttgtttacaaatacgtgggagaatgatacaataaacagaggaactgatacagcggaggaaaaaatgtctggattattgttggagctgcgcagacagattgcgcacaatcgtcggaaagctgcatatgaagaacggatgcgtgcatctgctcaggaaaaaccgcaggaggttttttcgcagaagacaaaagagacaaagccggacacggaaatacagcccgaagtacaggaaaggaaagttaatgttgtgagcagggaagatttcttacttagccagattgatgaattcagagaacgcgccaagcagttacagtcattgcttgattccagagagacggaggcacaggaactgcagacgttagtggatgaacgtcaggagaaagcagatgctctggggcagattcttgaggagcgtcagaaaaaagcagatggattcactgcggaagtggaaaagcagattgatcgtctgatcggcaaagtgtctgccaagatggaagaaatcgaagtttccatgaaggaagatgtggcagacggcaaacgcttaaatgaagaaaaagcaaaggaactgaaagattctcttgcgcagatcgaagaacagctgaccacggcaaaaacagaaatctccgagaaagtacatacagaaaatgtaaaatgctaccgaaatatttcggatctgttccgcagcatggatgaacgcctggacaagcttaccgttatggaaagcagaatgcatccggtccgtattttttccctgatgggaatgatacttggaatcgtgaatctggtggtgttacttttggtcctgctggttagtgtgggcgtgattgcgttttagaataaggatatgcaattctcaaaagaatgaggattgcattttttgtctcaaaaaaagatatagaacaattcgaaaagagaaatgtgaataggagaatctgatatggcaaaaaagaaagtttgggttgtaggacataagcatccggatacagattccatatgtgcagcgatttcttatgcaaacctgaaaaatgaaatagaaaaaaagaatcccaaaacagctacgggaatgacctatattgcaaagagagccggatctgtaaatgcggagacggcgtatgttctggaaaggtttcatgcagaggccccggcaatgatttcggatgtcggaacacagatcaaggatattcagatacgccgtacagagggagtaaacagtcatatctctatgaaaaaggcatgggagatgatgaagatcctcggggttgttacgcttccggtggtgcgggaaaataagctggaaggactgattgtaacaggagatattgcaaaatcctacatggatgtatatgataatacaatcctttctaccgcacgtacccagtacaagaatattgtagagacgctggacggacagctgctgacaggaaatgaacatgcgtattttgttcacggcaaggtggtaatcggaatcggtacaccggaaggagtgacttctgccatagacaaggatgacctggttatgatcggggacggggaagagtcgcagatgctttccattgcatcaaactgcagctgcatgattgtcactaacggatatgaaatcagtcaggaagtgatcgaggcggcaaaggaacgcgaagtcgttctgatcagtacaccgtacgatacgtttaccgcggcccgtctgatcaaccagagtatgccgatcaagcattttatgacaaaaaatggaatcattcattttgatctggatgattacgtggatgaggtaagagagaccgtagccaatatacggcatcgggatttcccggttctcgatgaaaaccagaactatgtgggtatgttttcccgcagaaatttgatgaaagcagagaaaaagaaactgatccttgtggaccacaatgaaaaatcacaggcagtatccaatatcgatgaggcggaaattttagagattatcgatcatcaccggctgggcagccttgagaccatgtctccggtgtatttccgcaatcagccgcttggatgtacatccaccatcatttatcagatgtatctggaaaggggaattacgatcacctcgcagatggcaggactgatgtgtgcagccattttatctgacacgctgatgttccgctcaccgacctgtacacagatagacagggaagcagcactccggctggcagagattgcagaggttaaggtcgaggagcttgcctcagcaatgtttcaggcgggaagcaattttgataataaaacagaagaagaaattttaaatcaggattttaaaattttccatgccggggatgtgagttttggcgtggcgcagatcagcgcgatgggacgcaccgaactggataaggtgcaggaacgtatcgagccgaaactggaacagatgatgggagaaaaacagatccagatgatttttgtcatgctgacggatatcttaaatgagtctacttatctgatttatcgcggtgcggatgcatcgcagctggttgcggcagcttataattgcgagccttccgatcaggggattatgttggaaaatgtggtatccagaaagaaacagctgattcctgcgctgatcaacacccttgcagagcgcaaaatgtaacaggcagacagatcaattgcgctgttctctgggagaacagccaaaatgtttgcggtatgcccgggaaaaggtggaataattgtgaaaaccacaggcataacaggcggtggtgatggatttcccctgggcgatctgatctcttgccagcaaaaggcgcttcgtggtcagatagtttccgatcgtataaccggtttcttccttgaaggcatgcatgagatgataccggctcagatagaaatgttcggcaagaaagtcgatggtgatgtcatctgttaaatgtgcatttaaataatctatcacatggatcattttatgatttgaggctgtggtagaaagatattcaatgcggttggagagagctgcacggtttaattgcaccatcagctccagaaaaagaagtttatgataaagttcgtttgcgtattctctggaatccagagattgttccagatcgtggataattcttgcaatctgtgttgtcttcagtgccggaatacgcagtacatgcgattttttctgatgcgcttcttttaagcagagtgagagatcgtcggaatcatgacaggcatccaggtagtgtctggaaatatagatgatgatgcgctcataaatttcagaactgtgcagaaccggacggtggaccgtacctgcgggaacgaatacgatatcccccggtatcagatcataggtacgtccttccacattgtaagaaatatttcctttgcgaaagatcagaattttatgaaaatcgtggtaatgaaagtcaatcgggcgcatagaggtatcttttaagtgaaaaatcttaaaatcgtcatgaagatatcctgttttttcataatgtgagagttctgacattgcataaatctcctgtaaatattaattagattcagtgtactatgtttccacacaatttgcaatataaaaagcactgtagttgttttagaagacggatcgtgcgggtatacttagaatagaagctctgaatcgacaggatggaaaagaaaaaaggagtgtagaaatatgaagtttacaaaaatgcatgggtgcggaaatgattatgtatatgtcaatttgtttgaggaaaagatagcagatcctgcaaaggtatcaattgcagtgagtgaccgccattttggaatcggatcggatggtctgatcactattggcccatcggatatcgcggatttcaggatgcggatttacaatgcggatggctcggaggcggagatgtgtggaaacggaatccgctgtgtcgcaaaatatgtatatgatcataaaatgacggataagaaagagattacgattgaaaccggagccggggtaaaaacgttgcagctgacggttgcggatggtaaggtttcgctggttcgtgtggatatgggagaaccgatattaaaaccggatttaattcctgtagatgcatcgggagaacaggtggtagatgagccgattgaagtagagggcagagagtggaagatgacctgcgtgtcgatggggaatccacatgcggtaatttttgtggaggacaccgaacattttgaactggaaaaatacggtccggagtttgaacatcatccacggtttccaaaacggaccaacacagagttcgtacacgttatttctccgacggaagcatccatgcgggtgtgggaacgcggatctgcggagacgcttgcctgtggtaccggaacctgtgccacggttatggcatgtatcttaaatcataagacagaaaataaagttctggtgcatctgcggggcggagatctgaccatcgagtatgatccggataacaatcatatttatatgaccggaccagcgacagaagtgtttcatggaatttgggaggaaaattaaatgaaaattaaagaacttatcaacgaaatggaatatgagatactggcgggaagcgaggagacagagattacgactctggtatatgattcccgcaaggttgaaaaaggttctgtgtttgtgtgcatcagcggaagtgtgcgtgatgcacatgagtttattccggatgtggcagcaaagggagcagcggccattgtcgtagaaaaggatgtaacgccgatcgatggaattacatatatcaaggtagaggacagccgtctggcacttgcctgcatgtctgcggcatattttgggcatccggcaaaaaaattaaagacgatcggtattaccggaacaaaaggaaaaacaacgacaacctatatggttcgttcgattctagagtctgcggggatcaaaaccggactgatcggcacgatcgaatcgattgttggttctgagcgtattccttctgcaaatacgacaccggaatcttaccgggtgcaggagctttttgcaaaaatggtagatgcgggactcgatgctgttgtgatggaagtctcttcccaggcgctgatgcttcaccgcgtatccggatttgtgtttgatatcggcgtgtttaccaatcttgaaccggatcatatcggagaaaatgagcacaaggattttgcagattatatgcactgcaagagtcttttgttccagcagtgcaggcatggaatttttaatggggacagcgagcatctgcagggcattttacagggacatacctgtacggttgagacgtttgggtatggagcagaaaatgatctgattgcgcagaaggtagagttaaaaaaggagcatggggcacttggtgtaaaatatcatgtgggaggttccatggattttgatgtggaagtcaatgtgccgggaaaattttcggtgtataattccctgaccgccattgcaatctgtcatcattttggtgtcagtgttgaagaaatcaaaaaggcgatgcttcatgtaagtgtcaagggaagaattgagattgtaccggtaacaaagagatatacgctgatgattgattatgcacacaatgccatggcactggagagtctgttaacgaccctgaaagagtatgagccgggcagactggtctgcctgttcggatgcggaggaaaccgtgcaaaatcccgccgttatgagatgggagaggtatcttcaaaactggcagatctgacggttgtcacatcagataatccaagaaatgaagaaccaatggatatcatcaacgatattctggtcggggtacacaaagccgatggcgcatatgtgacgataccggaccggaaagaagccatcaggtattgcatggaacatgccgaggatggcgatatcatcgtccttgcaggaaaagggcacgaagattaccaggagatcaagggtgtgaagcatcatatggatgagcgtgaactgatcgcggatattatccgggaaaatacggatctgaaattataacaggattataaataacaggaacaggcaaaaggagtggaaaaatgggaaaacagagttggaaagcgggaaatatgttaaatccggtgccggctgtgatggtcagtgtggcggatcagaatcatcggccaaacattattaccgtggcatgggcaggaaccgtctgcaccaatccgccgatggtttccatttccgtccgcccatcccgttattcttatgagatcatagagaaaaccggagaatttgtgattaatctgaccaacgaaaaactggcaaaggcctgtgattactgcggcgtggtcagcggaagagatgtggataaatttaaaaaaacaggacttacaccggttccggtggagcatgtgaaagctccggcaattgcggaaagtcctgtaaatattgcctgcagggtggtggagagccatccgcttggcagtcatacgatgtttgtggcggaagtacttggcgtaacggtggatgatgcgtatctggatgaaacaggaaaatttgacatcaacggaaccgggcttatcatgtattcccacggagaatattttgctctggggaaaaaactcggcaaatttggatacagcgtacagaaaaagaaaaaatgacacgcggcttattgcagcagcgtgtccatcagtacagcatatacatcttcacttttctttttccagttattgcagatggcttctgcctgttcttttgtagttacgcaaagcgtcaggtcgatcagaggattgccgtcagaccgtacctgacagcgtactgcgtatttctgattggttgtcttatagtaatctgccagaatggaattttcctgtcggaattctaatttattcttttcaaaaaatccctgaacatcattttcaattccatcatttaatttatctttgaaaaatccaagtgtttcttttcccgcagaagtcagagagtactgtgtgttgctgtgcgtggactctgcatggattaaattggcatcgaccagatccccgattacttcctgtacacggaaatagtctgtgtattcctgttccagaaagaaattggaaatctgggtgttggaaagcggaaaccctgctttgctcagcatatataagatcgtaagtttatagattgtaaatggttcagccataaaaatgttctccttgtctggtattgcgttctttgagacggcgatgaatggtgtttaaaatgcgttttttgtctgtgctccaggatggggcaagtaatagactgcggggaccatctcccgtcagacggtgaacgaccatgtccgggggaagaagttccaggcagtcgaccacaaaatcgctgtattcatcaagttccatcatgggaaacggatgaagctgatactgttctgccagtgcagtgccacgcaggacatgcagaagctgcagcttgattcccgaaaccggaagtgcggcgacatgccggacggtatctttcatcatttcttttgtttcaccgggaaatcctaaaataacatgtgcgatcacggagattccaagggcatgaagtttggatacagcggcatcaaactgtgcaaccgtggtatgcgtgttcatggcagacagcgtctttgcatggatgctctgcagaccaagctctatccatatgggtttttcctgattgagatcggagaggagttctaaggtttccggaggaaggcagtcacttctggttcctatggaaagtgcaacgatttcttccggtgccattgcctcggaatagagctgacgcaaaatgtcaacgggggcataggtgttggtaaatgactggaaatacgcaatgaatttctggcagtgtgttttggcggcgattttctgtctggcctgtatgaactgttcagaaaccggcagaaatgcatctgcggcaaaatcaccggagcctccggcactgcagaatgcacatcctccgtaagagagtgttccgtcgcggttgggacacgtcatcccaccgcttagactgagacggtacactttttccccgaagacctctttacagtaatcgttcagagaatagtagcgattagcggacatgagacttgactgcttcacttacaacttctgccacacgtggatcaaatgcttccggcataatgaaatcttcatttaattcctcgtcagaaactagggctgcaagtgcttctgctgctgcaagtttcatttcttctgtgatctgggtggcatgtgcctccaatgcaccgcggaaaataccagggaaagcgatcacgttgtttacctgatttggaaaatcgctccgtccggttccgacaacttttgctccggcagctttggccacatccggcatgatctccggcaccggatttgccatggcaaacaggatggcatctttgttcatggaagaaaccatttccggagtgacaatgtttggcgcagagacaccgacaaagatatccgcaccgcgcagtgcgtctgccagcgttccggaggtattttcaagattggtaacctctgtcatttttttctgcatccagtttaagttcggataatcttttccgatgattccttcacggtcacacatggtcacgtgtttgaaaccgtaagtcagaagaagcttggtgattgccacaccggcagatcctgcaccgtttaccacaacgcggcagtcttcttttttcttgccggtcacacgcagaccattgatgataccggccaaaacaacgatggcggttccgtgctggtcatcatgaaataccgggatatcaagcatttctttcagacgttcctcgatttcgaaacaacgcggagcggagatgtcttccagattgataccgccgaatccgggagctatatttttcacagcctgaatgatctcttcggtgtcctgggtgtccagacagatcggtacagcgttaacatttccaaattctttgaataatacacattttccttccatgaccggcatagcggcataaggaccgatatttccaaggccgagaacggcgcttccgtcggaaacaacggcaaccgtgttggctttccaggtgtatgtgtaggcagcagttttatcttccgcaattactttgcatggttctgcaacacccggggtgtatgcaatcgcgagatcctcgcgggtttttacttttgattttgcaacggtttcgagttttccgttccattctttgtggcataaaagtgccttttctttattatccatagtaattttctcctttacatactcatacttattcacaataccattcttgcgcatgaaaaaaaagacttcctattttaccggaaatagtgtataatagctgcattagataatatttgaaatgattcatagtcgtttctgactgatatcccatgcaaataagtgtaatttatgaaatgatttacggtacgaaacaagtctatatttttaagaaggagcagatggaatgagggaaaaatatgagagtctttctttggttgtgttaaaagacctggcgaaggcacgcggactcaaaggaatctcaacaatgaaaaagggagaactgattgatcggatgctgcaggaagatgagcgggaaaaagaggcagcgccgaaggcaaagacggtatatacagcgcggacagcttccggacaggaaggaagaaagcatacaccaaaaccgcgaagagaagagcattcgtcccatacggaggatcacagccatccggagcatggagaaagcatgcatgcagaacatggagcacatgcatcacaggaacagatctataaggcacaggaggataatgacagtgctgcgatcaaagaagatatcgtcagcctcgacagtggaaatacagcgagcggtattctggaggttatggcagacggattcggttttatccgctgtgaaaactatctgccgggggaacatgacgtttatgtggcgccgtcccagatccgcagatttaatctaaagacaggagatattgtctgtggaaataccaaagtgaaatccgagcgggagaaattttctgcccttttgtatgtgacttcggtaaacggatatcatccttcggaagcacagaagcggacaaactttgaggatctgaccccgatttttccgaatgtgcgtctgcgcatggaacgtcccggcggttcggttgcaatgcgtgtgatggatattgtttccccgattggaaaaggccagcgtggcatgattgtatccccgccgaaagcaggtaagacaacgcttttaaaggaagttgccaagtcggtaaaggaaaataaccctgagatgcatctgattattctgctgattgatgagaggccggaggaagtaaccgatattaaagaggcaattgagggagaaaatgtagaggtcatttattccactttcgatgagaccgcagaacaccataagcgggtatcggaaatggttattgagcgtgcaaaacgtctggtggaacataaaaaggatgtgatgattctcctcgacagtatcacacgtctggcacgtgcctacaacctgacctgtacgccgagcggccggacactttccggtggtcttgatccggcggcactgcacatgccgaaacgattttttggtgcagcccggaatatgagagaaggcggaagcctgaccattcttgccacggcactggtcgataccggaagcaagatggatgacgtggtatttgaggaatttaagggaaccggtaacatggaacttgttcttgaccggaaactttccgaaaagagaattttcccggcggtggatattgtaaagtccggcacgcgaagagacgatctgctgcttgatccgcaggagcgtgagggcgtggagaatatgcgccgggcattaaacggcatgcggtcggatgaggctgtggagaatattttaaatatgtttgcacacacgcgtacaaatgctgattttatcaatcttgtaagaaaaaacagaattctttaaattactattgcatttgcatggacgctatgttacaataattaagctgtttatcgggatgtaaacggacgaaagtgtcgctcttgtaataagtatcatatgcggatcgggcatacgggtataaagagtgtgacaggaaccagagtcagtcggaagactgattacagaaaacgataagaatataaagaggtgaaaatcatgagagaaggaatccatccagattattatcaggcaaccgttacctgcaactgtggaaacacattcgttacaggttctacaaagccggagatccacgtagaaatctgttctaagtgtcatccattctatactggacagcagaaggctaaccaggctcgtggacgtatcgaacagttcaacaagaagtatggcatgaaatagaattgataagtcacgtaaaaaggttgaggctgtgtattgcctcaacctttttctcttacagggggaaatatgaaatattcaggagttggcgggcaggcagtcatggaaggtgtcatgatgaagaacgaagaccgttatgcggttgccgttcgcaagccggatcacaccattgatgtaaaagtctccacatttaaagagacaattaaaaataaaaaactgcggcgtctgccattcatccgtggtgtcattaattttatagaatcactgatccttggcatgcagacactcatgtattcggcttccttttttgaagacgatgaggatgaaaaaaagaaaaaagaagccatgacgcaggaggaacgaaaggcgcaggaagagaaagaaaaaaagcaggagaaggcaatgatgggcggaaccgttgcattttccgttgtttttgcgctgggacttttctttttcctgccatattttctgtctgggatatttcataaagttatttcatctgatacggtgattgcgttgctggagggactgatccgtctggcgatttttatcggatatattgcgctgatttccctgacacctgatattaagagagtgtttatgtaccacggagcggaacataaatgcatcaattgcatcgaacacggaatggaactgaatgtggaaaatgtccggaaaagttcccggcagcacaagcgctgcggtaccagtttcctgctgattgtaatgctgatatctatcgtgttctttttgtttatccgtgtggattcgcgtattttgcagctggtgctcagacttcttcttattccggtgatcgccggagtatcttatgagtttatccgtctggccggaagatatgataaccggctggtgaatatactgagcaaaccgggactctggatgcagaagatgacaacaaaagagccggatgatgagatgatcgaagtgggaatcgcttcggtggaagctgtgtttgactggagaaagtggcagaaggaagagaatgtatgacctatagggaagcaattgtttcgggagaaaaaagcctgggtgaggctggcattgcagatgccagaaatgatgcatggctgcttttgaccatggcatgtaaaattgaccacacttactattatatgcatattgacgaagagatgccggaggaactgcagcatgaatttgaagtgctgattaaaaagagggcagagcgagtgcctcttcagtatatcaccggggaacaggaattcatgggaatgacatttcatgtgaattccaatgtgctgattccgcgacaggatacggaaaccctggtggaggaagcactgaaggttgtaaaaccggggatgaaggtgctggatatgtgtaccggttccggatgtgtgctgatcagtattttgaaaaatgtacacggtaccgggggatatggatatgatatttccaaacaggcgatcaatgttgcaaaggaaaatgcaaaattaaatgatgttcctgccattttcgagagaagcaatctgtttgaggatgttgcggatgaaacgtttgatgtgattgtgtcaaatccaccatacatccgcagcgatgaaattccgtttctgatgccggaggtgtcggaatttgaaccgcatgaggcactggacggaaaagaagatggtctgttcttctaccggaagatcatccaggaaagcccggattatctgaccgatggagggtatctgctgtttgagatcggatatgaccagggatgggcggtatcatctatgatgaaagaggccggatttgaggacgtctgcgtgaaaaaagatcttgcgcgaaatgaccgtgtggtctgcggacacaaacacctatgtgaaaagagaggatagattatgtttgataaattagaggatttacttcatcattatgaggagttaatgaatacattgagcgagccggatgtggcaaacgatccgaaccgctttcgtaaactgatgaaagagcagagtgatctgcagccaatcgtggatgcctacaaggaatacaaggcatgtaagcagacgatagaggattcccttgcaattcttgatgaggaatctgatgaggaaatgcgcgaactggcaaaggaagaattaaatgaggcaaagagccgtctgggagagctggaacagaaattaaagattctgcttctgccaaaagacccgaacgacgacaagaacgttattgtggagattcgtgcaggcgccggtggagaggaagctgcgctttttgcggctgaaatttaccgtatgtatgtacactacgcagagcgtcgtggctggaaagtggagacacttgaggcagatgaaactggaatcggaggcatgaaatcggtcaactttatggtgactggagcaggcgcatattccgtactgaaatatgaatctggtgtgcaccgtgtacagcgtgtgccggagacggaatcccaggggcgtattcagacatcaacctgcagtgttgcagttatgccggaggctgaggatgtggaagtgcatattgacgacaaagacatccgtatcgacgttatgagagcgtccggaaatggtggacagtgtgtcaatacgacggactctgctgtgcgtctgacgcattatccgaccggtatcgtgatttacagtcagaccgaaaaatcacagatccagaacaaggagaaagcgtttgcactgctgcgtaccaagctgtatgatctcgaactgcagaagaagcaggatgcagagtctgaggaacgacgcagccagatcggaaccggagaccgttccgagaagatccgtacttataatttcccgcagggacgtgtgacggatcaccgcatcaacctgacattatacaagctggacaagattcttgacggagatatccaggagattatcgatgcatgtatcgcggccgatcaggcgaagaaacttgcaaaaatgcaggatgaaaactaatctgtccggtttatgatgttcgttttgctataggtattagcagataaatgtagttggtattttccgccagttagagaattatcaaaataaattgtaatattgcttggagtggatcagagtcagccgaaaggctggctctgattttttgctttttttcacagtctggtgaataattgtatagcccatgaaattttttaagaaaattagtataagacagcttaaagaagaacagacaacgctgacttgaaaaagtaaattccagtgcaggggtaaattacaccatgctttaaaattctttgattttttagaattgtgggaggctaaatccttataaaactgaaattatccaatcgggaattggacaatttgaacaggcttttggaattgtccaattcccgattggataattagagacggcatataaaaaaatgccatttaagttgagctggacgcattatcagattcttatgcgtatagagctggtcacattatcgtgtcttgatgcgtataaatgatgaacaggcaagaagattttatatggaagaatgtgcaaaagcagcatggagtgttcgtcaactggaacggcagatcaatacgatgtattatcagcgtattttagcaagccaggataagatagcggttgcaaatgaaattcaaacaacagagccaaaaccagaatatgagaaaatagtgaaagatccttatgttatggaatttctgcagattcagcctgacacacatgtatatgaaggagatttggaacaggcattgattgatcatcttcaacatttccttttggaacttggaagaggattttcatttgtagcacgccagaaaaggtttacattggatggacaggacttttttattgatctggtattttacaactatattttaaaatgtttcgttctcattgacttgaaaatgggtaaactgacccatcaggatctaggacaaatgcagatgtatgtgaattactatactcgtgaaatgatgaatgaaggagacacgcagcctattgggattgtactttgtgcagataagggagattctattgtaaaatatacgcttcctgaagataatcaccagatatttgcatcgaaatatttcatctatctgccgtcagaggaagaattgaaacgtgaattaaatttgaaagaatttcacaaaaaagaataaaaacggaaatgcaaagcggaagttatagtaaaggagatttacaatggagttttggatttttatgttgattatggatttgcttcttccatttacgatgattggttttggaaaatattttatgaaaaaggctccaaaggaaataaattcagtattcggatatcggacttcgatgtctatgaagaataaagatacatgggaatttgctcataaatattgcggtaaagtctggtatgtctgtggaatggttatgttgccaataacagtaatattcatgcttttagtaattggaaaaagtgaagattgtgttgggagtatgggaggaattatttgtggtgttcaacttattcctttaattgggtctattctcccaacagaaatagcattaaaaaagaattttgataagaatggaataagacgataaagtttgcagaatcaagaaaatcgggatttgtgaaggaggaatatactatgaatatagggttttggctatgtggagttttggttattccatttgtgattataggagtgttatttgcaatatttaaagaaaaagcggctaaatttgtttcgggatttaattcattaccgaaagaagaacaggcattgtatgataaagctcatgtttctcgtgatataaaaaatcagtgttttacatgggctggcataatgttagtaggagcagtgttgtcttattttttaacaccatatatggctattccggcttttattatttggctcgttttacttttcaaagaggttcactttgacacgcacaaagcatttgaaaaatatttattaaaataaattccagatgataaagcagaagtatagggtttgattcatatgatttcagtaaaaaaacagagaattgctgctattatggttttaagttccatcatgctgattttacttttgtcactaaatttccgactctggagtggatattatgcagaaggggatttggaaagtatagtcatacagcagatggaatgcttggaaaagtcaaatagtgaaaacgatataagcgaaagtatatgtttgcatttctatgagtgtatatgtttcggtggaatagaaataatggtgctctgggtatatgatggctttaaagacctcggacaaggtgagttttctttcagaccgggagttaccctttgcagtctatcggttcggatggatgattaaatacttctgataatcaaatttaaaatttattatcaggaggaacttcgatgtatgtattaaatgcaaatcatatttcaaaaagttataaaactgcaggagaaactatgcggattttgcagaatgtgaatctgcaagttatgaaaggagaaatggttgctattatgggaccatccggcagtggtggtcatgttaaaataagactaagttagcagattccttataaattaagggttcacgccaatttagtcttttttctattataccataaatggtagaaatatcatagaccgggaatgaatttcgcataatggaaattaggtggcagggacttttaatgatagaaaccctttgctactggtcctgttaaaatatccattctcacaggcggtcaagtttgtgaaagaccattcggttgcaatatattgtaaaaaaagatatggactaggttagttaaaagtgattctgttagctggcttagtccttttttcatgggaggatggagcaatgataaaagtaatcataataattggtttacttatttttctgtttcctttgtatgcgtgcttagttgttgccaaaaaagcagatgaaaaaatgagagttttatataagtacaaagaaaaatgggaaagtgaggataacatatgaatggaggtatatacagcacaggaaatgaaattgtagacgaaaatgcaaaactgaatatatctggaaatatcattcctcaggtatggtatcggacgattatcagagaaagcggaaagccaaatctgacggctattatcatactggcagatattgtgtattggtataagcctacagaaatcagggatgaaggaaccgggcaggtaatcggggtaagaaaaaaatttaagtctgaccttcttcagcgaagttatcagcagatcagtgagcagttcggaatttccaaaaaagaagcaacaaatgcagtggtatttttggaaaaactgggtgtggtaaggagagtatttagaactatatccatgaatgggattgtggtcaataatgtcctgtatctggaattgatcgtagacaggctaaaagaattgacttatccagaagaaacaggtgcagttttgtcttcctttgaaaacggcagagggaaatcgaaaatggaagaacaaattccctctacaaacatagacgaggaggttcatttcataggagagagggctgtcccttttcaaagtgagagggtaaccccattcaaagagggagcataccctcttaggaaaacagagccttggacaccaaaagagatacctgaaacctattgtgggcagacaaatacagagattactacaaagactacagtagagaatactccaaagaatacaacagagattatgaatgaatatgaagataatcctatcttatcctatcagatagcagaaaaacagttcaaagatcagattgattatgatgcgatatggatagacagaccttatgacagaaagctgctcaatgagattgtagggcttgctgtagatgttttgacctccaacgcaaagacgatacgggtaaatcaggaagaacgccctcttagtgttgtgcagggaatgtataaaaaactggataaattctctgtggagtatgtgatggattctattaaacagtgtacaaaaaaagcaaataatatcagggcagtgttactgactgctttatataatgccacattgacggcaaacagctatatatctaatctgtttgcttatcatgaagctatccctcagacataaggagtgtgataggaagttacaaaattaaagaaattcaggacagcccatggatatacgcagatagaacttgcatctgtcctgggtatcagtcttcggacatatcagaggattgaatatggacagcaaaaaccaaatgtccatgtggttgtccggctgcagaggttattccaaaaagaaatcagtgagatgctggagccatttgcagaagagtgaacagatgaaaaagtggaaagatacaaaatataaaattcaggaggataagaaagtggaaaataaaatgattattggaatagaccatggaaaccgtaacatgaaaacagcaaataccgtattttcagcagcaatccagcccttgcaggcaaagccagacagtctggaacatattctggaatatcagaaccagttttattatgtgggtgggaaagtaccggaaaaagagtgtgtggataaaacagaaaatgaaaactattatcttcttaccatggctgccctggcacaggagatgcggtatcggggattgacagatgcttctgtgaaaatgggagctgccctgccgcccagaaggtttcagcagcagaaggaaagtttcaagaaatatctgttaaaggcaaaggaactgcatttccgctatgaaggggttcactatcatgtgtccttggaaaatgtgtttgtctttatgcaggggcatgtggtgatccatacgcttttagaagctgttcctggttattgccttttagtggatattggcggaggtactaccgacctggtagagtttgttgacggaatgccggacgggaagtattcgatttcggataaggcggcgttgtactgtatcggaaaagtgaatgaggaagccattgcaaaaacaggggcaggggtaccggcatacattacagaagcatttatgaggacaggaagctatgactgcccgaagcagtatcaggaagtgattataaactgtttgaaatcctatgcagaggaaatttatggtatcatacaggcaaatcattataatctggacctgaccaaaatggtattcatgggaggtggttcttccattgtggaccattttggagctaatgagggaaaagatgtacagtttgtgacggatatacatgccaatgcaaggggctgtgaagaagcagtaaaaagcattatccgggcaaaacagaggaaaatgcggacggcatgataggaagtgaaggcttatggatacggaaaaagtatatactacttcactgcggctgtataaaaacaggccagtacatcatcaggcataccgatatctgaaggagtataacaaagatattttcaagacgaaagacgatttcatagcagaagcaatcgtttattttgcaaaatacctgcagcaggaagaagatgtacagcagatgaaactattaaatacccttctggagaaccagaaagaacaattttgtaaaatcgtaaaagatgccgtttcccaggcacaaaaagaagcctttgctaacaggaacgtattagcagaaacatttcagggggaactggctgacagcggacagatagcaggaaacagtgaaaaggaagaagcctgtatggaaaaagatttacgatttgcggaattttatggggcatttgaagagtaaaaggaggaaaaaggtatggcagtaggaagaaccgtatgggaagttgtaaaagggattttgatcgcagtggggaaactgctgtatctgacagaaaaattagtattatgcttgtttctgctggttctgcagcttgttttggcagtgttccatgcaggaaacagggaatagaaaggggaatggcggttgcattggatacgggacagaccgtacacaaaagatgcaaaaaagaagatagaaaatggaaagcaggcttgtgtggcctgctttttttgacgaaaaaaatgaaaaggagcaaagttatgatgaaaggaaaaaagaaaaggctgctggctgggacactggcacttcttcttagctgttcgacattactcaatacagggataacggcactggcttccgggcagtctggggaaaatagccggatacagaaagcagaagcaaaacaggagaaaactgctttggatacattaccggaactggaagagataaagaatcaactgacagaagaagaactggtgtatgcagaggatcttaccataaaaacaggagaatcatttgacccggaatccgatgatactggtttccagaaaaatgatgaaaaagtagaggtaacgttcctgaaagccgaaggggaatctggcaatccctttgactttaacgccccaggggcttaccaggcattttatcgtgttgatccgttaagcggaaacccctcttatcagattatgagaaggattgtggtagaagcaagggaaaacagcacacagcaatcccagggggaaagcagccagcatacagaaagcggctccgatgaggacggtgaggcggaccctgagccagagataccggaggtactggccgaagaaccggaaatgccagatgcaggaacagagttaattgaccttacaccagaagaggataagggaatgtacttatccgttgttccggcagcaatggaaagggaaaaaggaagcaatgtacatctggtacagggggagaaaatcccttacccgtcaagtgtagggaattattccacttcctattttacggtaaatggacatgtggcgtactgcctggaatccatgaaagcttctccaccaacttcggattatgtggccaatgagtttgaaagcaacccggaattacagaaagtcctctattatggatatggcggtcctggggacattaccggggagtatatgccgtcttttgactggaaaacaaagtatatttttacgcatttagctgctgcatattcgtattgtggcatggacggattttatggctgtacttttgaagatatcaaggcaagcggtgtatggggatatatccagcatatttacagcctggaagcacctccgacagcagcaatcacattatccccaaaagaagcaaaggcttatgaaagcggtaatgagcagcgtaccggggaatttagcttaaaaggcgaccatagaaactatattactttaaaaatgccagacaatgtgacctaccacagtggaagtacaaaacagacagggactgtaaagatcaaaggggacaccactttctatttcagtgccccaaaaacagtaaccggtacatggaacagcggcaagctgaaaggacagatgggaacgcagtggaagacattggtattatctaccggctctggctcacaggatattggatatggggcattttttgaagaggaaagtgcttctgtagaatttacagtgaagtggttagatctggcaagggtaaaggtgacaaaaaaggataacaacagtaaggtaaacctttccggtgctgtttttggtatttatctggacagtgcatgtaaaaaccttcttatagaaatgccggcaacagacagcaatggtacttccgaggttgaatttccaaaaacccaggatacggtatatttaaaagaaatttctgttccagaaggttataagctgaatacagagtcttttaatgtgaagctggaaacaggaaaaacaacttctgttgcagtgacgaatgaggaacagaaaggaaaaatcacaatccgtaaaaaaggtgaggttctgaccggagtaaccggagaagagggaaacctgacttttgtatatggaaatgcggactttgcaggggcagaatataacatttatgcggcagaggatatttacagccaggataaagtgacgaaggtgcataaagcaggggatctggtagaaagtctgacaaccggggaagatggaagtgctgtttccaaagagctgtatcttggaaaatataaggttgtagaacagaaagcaccggaaaatttggtgattgggaaaacagaacaggaacgtacccagtttgtaaccttgtcctatgcaggacagaatgtagatttatcccagggggaaaccatttttaccaatgcaagaccggagatttccgtaaatgtagtgaaaaaatcggaacatgatgacgttaccctggaaggtgcgacctttgggttgtatgcagaagaagacctgacagcagcagacggaaaggttcttgtagaaaaaggaagcctggtggaacgtgctgtttccgacagggaaggaatagctgtgttccatgcagatattcctttgaatttccattacagcgtgagggaaatccaggcaccagataagtattatatgacagatgaggtgtatcgtttcttctatgaatataaagacgacagcacctacacatatactttttcccatgattttaaaaatgaggaagtacggggagaagttcatgtaagtaagattgaccaggattcccagggatttatttcccagggtgacgcaaccttagtaggggcaaaatacggattatatgctgcacaagatattgaacacccaaataagaaagatgggattgtccataaaaaaggggaacttgtagcgcagggtacgatttctagtgaaggaaccgtagatttcaaaaacctgtatcttggaaattatttcgtaaaagaaatagagccggcagaagggtatctgttagatgaaacagagtatcccgtagaggtttcgtatgagggacaggaagtacagattgtacaccgggaggtgactgtaaaggaaactgtaaagaaacaggcctttcagcttatcaagatttcagaagatggggaacagacagaaacagaactggtggaaggggcaggattcaaggtattcctcatcagtgaattgtctggcgtaaaggatggcagcctgaagcctggaaatggctcttattatacaccggaggactttatcacatatgattacagcaaagatgaaaccgcttcttattgggaaaatggtaaaaaaatcacagtaccagagctgtttaccgataagaaaggatatttgaagagcccagagcttccttatggaacgtatgtggtgtttgaatctactgttccggaaaatttaaaaggaatccgcccatttatcgtgcagatttcagaagacagcagggaacctcaggtatggcgtgtgtttgatgaccgacctttgcagtattacttcaagattgtgaaaaaagatgcccagacacagaagcccgtactggataacagtgcagcttataaaatttttgatgtggaagcagaaaaatatgtggaaatgatcgtaagatacccgaaaaaagaagtggtatctgtgttcaggacaaacgaagagggatacctgatcacaccggaacagttaaagtgcggtacttaccgaatcgaagagatagaagcacctgaaaactatgtacagataggatttgaaaatgctctcttaaaagatggaaaggaagttccgttgaatgaaacagcagacgggggaacttaccaggaagcaaagaaagtaccgatcacgattactgtagatgcggataccgtacaccaggtagaagaggaaaccggtaaatttattgttgtcattgaacagtataatgatgaagccgtaggaagccttacaatccacaaaaaaggagaaaaactttctggtgcttccaaagtagaaggaaagttcctaacaaagatgaaaaacggtgtggctggtttcgtaaaccaggtaagcagtttcttcactggggaagaagtcatggaaaaagagaagggctatgaatttgactacgaagaggggaacatggaagctgcagaatttgccatttatgcaagagaaaccatttatacccctgacggacagaaggatgaagctggaaaccgtattgtgaaatatgaaaaagatactttggtagcccttatggtgacagataaagaagggaaagccgttcttaataaccttcctatcggaaaatattatgtagtggaagaaaaagcaggacagaactgtgttcttgatccagaagcaaaagaatttgaaattgcatataagggccaggaagtagcagttgattatgtaacgatggaacttatcaatcagcgacagaaaatttccctgagccttctgaaaaaagacgcaaaaaccggaaaaccgctggaaggagtaggattcggactgtatgcacaggagtctatccaaaatgcggtaggggaagtgattgtagaaaaagatgccttgatcgagctgggaacaaccgacaaagagggcaagctggtatttcactctgatcttccccatggaaaatattacatcaaggaagtagagcataaacctggatacctgccaaatgatgaagtgtattcttttgatgcgtcttatacagaccagacccttgaacttctcgctttttcagaagaaatttccaatcagccgaccattacagaatttacgaaagtagatttaaccggcggacaggagattgaaggggccaaaatgcagatcctggatcaggaaggaaaagtggtagaagagtgggtgtcaaaaaaagaagctcatgtagtctacgcactggcaccaggggaatatatactgcatgaagaacaggcgcctacagaacagggatatgtccgggcggaagatgtaaaatttgttgtggaagaaactggggaagtacaaaaagtgaaaatgaaggacgaccatacaaaggtttctatctctaaaacagatattacagatggtaaggagattgaaggggctaagctgcagatcctggatcaggaaggggaagttgtagagtcctggaccacaggagaagaacatctgattgagtaccttccggtaggaacttataccctgcatgaagaggcggcagttgatggatatattgtagccaatgatgtggagtttacagtggaagaaactggagaaatccagaaagtaaaaatggaagatgagcgtgctatgggacaactggttatcgtaaaaacggatgcagacagcaaagcgactctggaaggagtagaatttgttctgctggaaaaggaaaccggaaaagaagtaggacgtttgaagactggaaaagatggaaaagcagtttcagaactacttccaattggatcttatgaaaatggtgtcttcaaagaaccgatcacctatgtactgaaagaaaccgccgccttaaatggatatcagaagacggaagaagagtgggaaatcgtattcacctatcagaatgataaaacaccagtcattgaagtggtaaaagagatccagaataaaaaaataccagaaacgccaggtaccgtaaaaccaggaccaaaaacgggcgatgatacaaactggttcctgcccctgctggctcttggtgcaagtgcaggtatggtagcaggtttgctctattacagaaaaaaagataaaaaggcataggaaataaaaatcagtttttaaattggggaaagggcagctacggctgtcctttcttttggaagtgtgaggtgagaagcatggaagagaaaaaaagaatacggtttattgacagccattaccataccctgtttaccatagcagacggtgaatctatagagatcatatccccagacggaaaaaggaaagaacaggtttgtatctatcttgacggatatcatacaaaggtaggggggaatgtgttccatatctgtgagtttgcagaaatcatggaggcaaatggtaaatcctattgtcctgcaagaagcagggaaaaagaagtggaagaaagaaaggaagctgcctaccagaaacagaaaaccggaagtatccgtatggaaaggagcaggcgttgaggattgggatcatagatgcagaccttttataccggaaaagacaccgttttcccaacttggcatgtatgaaactctccgcttattggaaggagcagggatttgaaacagagcttcttttggattacagccaggctggagaatatgaccggctctatgtatcaaaggtttttacggataccttcgtgccggaacatattctgacgagggaaacaaccctttatggagggactggatttttttacgataaagcaccggtacttccagaagcgattgaacaccatacaccggattatcacttgtatgaccggatggtaaatgacaacagtacaggaaaaaaacagaagaaagagtttgagttttatacagattattccattggcttcctcacaaggggatgtttccgaaagtgcagtttctgtgtaaaccaaaatagtagcggtgtagtagcagcaagtccattggaagaattttatgacccctccagaaagaaattgtgttttctggatgataacttttttgcttacgcagggtgggaaaaaatcttttccagtgttctggaaacgggcagacggtttcagttccggcaagggctggatctgcgtatcatgcaaaaaaaacagattgaacttctggcatctgggaagctggataatggtatggtctttgcctttgaccatatcaaagataaagaactcattgaaagaaaactggaacttctgcgggaggtgattcctatttcttatcacaaggtcaagctatatgtgctatgcggctatgactgggatggcacctggctgccagatttctgggcggcagatatccgggatgtttttgaacggataaagattctgatgcaatatggatgtcttgcgtacctcatgcggtacgaggcatggctacgggcaccggaaacttataaaggaatgtatatcaacctaagccgctggtgtaaccagccagcacagtatgtgaaaaaaagcttacgggaattttgtaccgggcagggagaaaacagttccagtttccgatatctggctgcatttgaagccttgcacccggaaatgtcacattatctggatatgaaatatgaagaggtgcagcatgggaaaatttacgtctgaagagattcagattgcgaaggcagtggatttagtggacttagcagagcaggtagggattccattgaaacggaaaggaagattttaccaggctgtgggaatggattcggttatgatcttcaaccggtcctcctggtgccggtttagccagggggtagggggcagtaccattgacttcctggaatatttcaaaagcatggattttgtggaggcggtaaagtatttgcttgagttttccggatatatccgtaccggaaccatgcaaaaagcccaacaggaaagacagcctggaaagccagaagaaacaaagcagaaaaaagagagcccgaaggaaccctttgtacttccaccaaagtcggaaaccagccgccggttatatggataccttatgaagcagcggaagctgtcaaagaaggtgatcgacttctggataaaaaaggggcttttgtatgagagcggaaattatcacaacctggtttttgtgggaaaggacccggaaggtgtcccacgttttgccagtcagaggggaaccctggataaatatgggaagccctttaagggagatgttcctgggaacgacaaaacctatggggttaatctggtcaatacgcatagtgatacgctccatgtatatgaggcagcgattgatgccatgtcagatatggagctacggggagattgccagacgaatatcctggtgcttggaatgctttcagacggtcctctggaaaaatttttaaaagattatccgcatatcaggaacatacaattctgtctggataatgacataccaggaagaaaagctgtaaaaaaactggcaaaaaaatatactcttatgggctatgaggtcttcgtgcgtcttccgcctgtgggaaaagattataacgcttttttgcagtatgcaaaggaaaaccaggagctttctttccatatacaaaagggaagaacatcttttacagagagaaaacggacagaaatacaaaagacagaaaatcctgtaggatacaggaacatagcaccgtaccagatagcacaggcaagataggagggtattcttttggataatagctatgatgaggaaagtttaaaaaaatgggagatagatgaatgcgaagctgaaatagaagaaatcgtgcagtggttatataagaggaagctgcatgggcatatgcggattccgttcatcgaggagagctatgaacggcagggataccgtatggggataccaaagcaggtgtatgtgtccagggtactggaaaaaatcaggaaaaaaggattgggaaagggtggaaaacatggagtttgatatcttttatgaagaattgaaaaagcagattctggagatcgcctcagaagaattacaaggggatatagatttccgtatggtatataaaaatggccagccgaaacagggaattatattttccccggaagggagcaatgtagggatcacgacctatgcagaagatttttaccgtatgtatgaagagggaataagccttccctatattatagaaaattatacagggaccatccatgaggcagaagataaaatacagtttgcaaaaaatattccggtatttgaagcaaaaaaagaagatatcattcccacttttgtccctagggaaagtctgcaagatggatctgtgcttgcacatatcccgtttgaaaatctggagatcgtattccgatggaacattcccggtacaacattaagtgcaaaattgccggaagagtatttcaaataccatcagatcgaaccaaaacaatttttggatgagatcatcaacgcatcttcttttaaggaacagataaaagtatttccccttagcaaaattttccatacaggggatacagagattccccatgaacaggagatgtactgtatcacgaacaagaaagaagactggggagctgcttctattctgaataaggatatcatggatgaaattgcagatttttttggagggaaaacttatattatccctgccaatatccatgagtgtatggctatagatacacatagacatacactcgaagcacttaaaacaatgatccaggaggtcaatgcctcccaggaaagtgtcgaaacagactttttatcaaacgaggtgtacgtgtatgacagttataccagagaactaaaattggcaggggaagaaagaacaaaagaaatggaaaatccccaaaagcaggagaaacccatgagataagaggtggctgctgaaatgggggatggaaaggaggtggtgcagaccaacagggttcgtgacagaagggcagactatctggatacggaaaggggtgattctatgattgtaagataatgccagatggatatttcgtttgtagctgtggatttctcattaaaactataaaaatttaggagacaggaggaaataagtgagtaatcctaggtaaaatgtgtagctacacctcatgaaacatgaggaatgaaatatagtttggtaaatttttgtgagtttgataaatatgcagcaaagagttattgtgcgattcatggtacaagtgaaacattgaatctgggagatattacaaaagtggacgaaagagagattgagccgtttaacatgatctgcggcggaagcccctgccaggatttttccctggcaggcaagcaggcaggggctgtctggaaatgccggaactgtgggcgtgagtataaccccctgcaggtgcattattcccaaagggatacctgcagcatgtgtggttcccatgatattgacaagacacgctcttcccttctggtggaatggctccgcatgatacggggcgtcaagccggtatggggaatttatgaaaatgtaaaaaacatcgtaggaaaaaaattccgggatactacattccggctttttgaagaagaactgcatgaatatggataccatacctattggagtgtcctcaatgcgaagcattacggaataccccaaaacagggaaagggtttatctgatcctgatacagaaggaaatggataatggaaaatttcattttccggaaccactaaagtctttccggtgcctcatggatgttctggaggatacggtagatgaaaaatactacctgtcccaggaaaaagtacgccggctgcttgaagatatggaagaaagaaaagcgcttttgtttgaaccggatgaaaaaagcctgaagattttccgggaaaaccggatgaaaagggctgggactattaaaggggaatttgaacagacgggaagggtttatcttccagacggatgctgtcctacagtgactactggcggcggtggcgggcagcagccgaaaatacttcaagtgggggatatccataccggttatggttcaagtggaacggtttattcaccccttggaagctgtggtacggttctggcagggcatgaccagccaaagatcgtagaaaaacatcctggagcaatccggggaaggtatgataaagagggcaggattgtacagacattggaactgggaaaaacagaagtctgccatacccttacttctgttcaaaaagacaacatcattctggtacgccaaaagacgcaaaaaggatatgaagaatgttggaaggacggtgttgcgaatcttagctatccgtctgtagaaaaacggggaagggtacaggagcatgggaatatctgccctacgcttacgacaacaaatgggatacaccgtctggagtccctggtccgtatccggagactgacacctttggagtgcttccggcttatgggattttccgataccgatttttggaaagcaaaagaagcaggcgtaagcaacagccagctttataaacaggccggaaattccattgttgttgatgtactgtattatattttcctggaactgcataaggctatgccttatctgtttgaagatattcggctttcttcctttttcagtgggattggagcgtttgaaaaggcattggaacgtttagaagaacaggtaaaccaataattccataaaagaaacctaaagcggcaaacagtccaccggggatctccccgtacttgttggaaagagagatattacagaagaaaaggaaacttcccgtacagatagaaaacagatgtttctggtatgctttctatatccttgtttctggtaataggaaggagtacaataaaaacagacactggcatctgaatggaggaggaaaattatggaaacaaaagaactggaaaaaatggcgtatctatatctgtgcagcccaaaggaccgggagaaaattttaggcaggaaacccatgagctatgatgatttccaaaggctgtattatctggcagagtatattggcttcccggcctttgcacttgcgtttttcaaccgctatgcagagaattttcaggtgcaggaatcagtcttggaaaaaatccatgatggctgggataaagatctatactgtgatacagagtattatctggaagagcgtgccaggtgggtgagcagctttttagaaggtgttccttctatggtaagaaaagaagtacgggaatatgtgaaaagccatgatgacagttgggaagtgtatgaagagattatgaaacggctgcatcttccatgttgacattcaattgggcaaaccagaaatcatgctgacattgaaaaaatgtggtagcagaataggaaaactgttagcaaatcagatgcagaaggctgacaggtttgctaacaaaaatatgtttctgttagcagaaacaggaaaaggaaacagaaaaaccgatagcagatgtttggaactgctatcggtttttctgtatataggacgcaggactgctatcagtacctgcgttttgctatctattttatccggggtattagggggcatccccctaacaagatgggattttgtacggcaaaatccgtatcttgcagaggactggcatagccagtccggacaccgggaagttatatggtgaccgatagcaggtcttaggagttgacagcagatagcgttggagtagaaatcggtagatgaaatatgtgataaagataaggaaagggggagcatgaaaaaagaaacaatgaaatgcagaaaagaaatccggctgtactcatgggagttggaagagttacaaaaacaggcagaaaagatggggctttccgattcccagtaccttcgtatgctgattaccaaccgtcccagggattacccggaaatccgtcaggaactggaacgcatgaaccaggaaatcaaccggattggcgtaaacatcaaccagattacccataacaataacagcgccctttattccagggaagataaacaccgtctgtatgtgtttttgaagcagataaaaacactggtaagccaggtgcaggaaaggctgtaggttatggcaattacaaagtgcctgcacatgaaacaggcaaaaatgggttatccagcgaaacatctggcaaacggtcttcgctatattatgaacccggagaaaacagaacatggccgctatgtctgtggacataactgtattcctgaacaggcattatcccagatggtagataccaaacgtcattttggaaagctggataaaaggcagggctaccatttcattctttcgtttgaggaagatgaggtttcggaagaagaagccttccaagtggtaggagagtttgtgacagaatttcttgggaaggattttgaagcggtttatgcagtccataatgatacggaccatattcatgggcacattatttttaattcagtacgctgtactacgggatataaatacgattataaaaacggggattgggaaaacatcattcagcctctgaccaaccggatatgcagggagcatggtttatctgtgctggatctggaagaagcaaaggaaaaacgcaaacaaaaaggacaggaagaaaaatctctttctgaacgggacaggcggatcagaagagatgtggaccaggcattacaggacgcaggttcttatgaggaatttcttgaaaatctttccagcatgggatatgagttgcgggggagaaagcgcctttctgttcgggaacccggagcaggaatggcaaggcggcttgaccagctaggggaagaatatacagaggaaaggcttcggcagcgtttgggacgccttccaatcccggaaatgaccggagaggagataccggtagaatggacgtatgtgtttatcccataccgggagcggcatttgaccagataccagaaggaatgttttcttcgcaggtaccggcaggggaaaccaatggcagactctaaaacctggaaatacagggcagcaatccatgaattgaaaaaattgcaggaggaatttgattttctggcagcttatcgcatacaggataaggcgcagttgaaagccatttctgatgcaacaaaggaacagctttgggaaaacagcagggcaagaaagcagctacgaaaagaaatggttccttatgaggaaatgcttctgcttctcaataagctgcaggaaaaacagatggaagcaaaactttatcaggaagggtatcaggaattttttcaagaccaccagacataccaaaaccttcttgggcagttaaaagaaatgggatattccttgtctgaggcagaacagacagacgcttatttctttgagaaagaggagcgtttgcggattgaacggaaaaaaatcttaaaagaaaaaaggattgcagagcgtctgcatgaaaaagcagaagaaaaagaaaagttggaagcacagcagaaggaaaagaataggaaaccgtctgcgaggggcagaggaaaaggagggtaaatgacagtagaaggacaacggtatctggaagaatgccggaaagttttaaaagaagaacagatggacgcagtttctatggggctggattttggtcttcctgtttcggatatccagaaggtagttaagagtaaccaggaagccccggtgatgaaagcaatcatcatagggcttatggaagggattggggaaatcgactttttatgtgaaggaaattataaccagttccaggtacgggaaatcgtagagggcttaaaaaacgggctggatctggaagaggtgaaaacctatgctggaaatgaactgccggccagccgtatgcggaccatgcggatacaactggaagagtcaaaggcaaaaaaagaagttccgaaagatgaagaaatgcgttcttatatgaaaaatcttatggggatcatggaacaatccattcagcagtttcgggaaagcaatgaccgttttacagccttgtcctctctggtaaaggagcatgttgttgaagagaaaaaccaggagattaaagacctgtatgagaacctgcaatataaagataaaaacatacaggaattaaaagaaaagctggcaaagaaagagcaggaaattcaggatctgaaaaaagaagcagaaaaatacagggaaaaaacagaagctgcttccagggaaacaaaagtggtattggaagaaaaaagcatacaaacagcggaagggctacaaaaaagtaagcaccggctgcttgggattgccatgcttgggaaaaaagtacccaaaagtgttgtggagaaaattctggaatataacctgtccgcagaacagttggaagaaatccgccagtgcgtagaaagtgggctggcagatgcagaaattcttcaggtgatggagaacagcccttcaccagagagaatgaaaaaaatgcgggaaattatccttttgatgcggaaacggaaggcgggtgtgtaaatggcagaacttgaacatgtggtaaaaacattttcccttttggaaactgccgaaaaggaacagccctttcttaccagggagcagaaacaggatttgtaccgtattgcttttcataaggagtctatggaagaggtagaaaaaattattttgcagttacaggcgcctcatgcaggaaaggaagaaaaagagcgtattctttatcattaccttgaaccgttttttcaggttccggaaaatattttgcagattgagaattatatttttcagcttcagtatatgacctatgaaaaggaaaaagcaaaccacatgctggaggctctcttaaaacaggaaaatatccagtatgacctggaagccatgcttacagaaggaaaaataaaggcggctgttccagtaaaaaaggacagggcaatgggataggagggagcgcatgagtgaaatacaagatgcggcgcagattattaaagtttcctttgaaggcgcagaaatcattctgaaaatgggaaatacaggctggcagtttgtaaaagatatttgtgcggtatttaaaaaagttctggatcaggaaaaactgtcagggaaaacttctgtacaaaagctcctgaaaatgggaggcgatttacaggttttccgttttgaaacaaaagacctggagcgggtaaaagccctggcaaataagtatgggattttatattccattttgccggatttaaatgagaaggacggtatgagtgaaattttgttccattcccaggcagcgccccgtattcagtccatgatggcaaaaattgaacattccaatattgggacgttagatgaatactatgaaaatgcagagccggataaggtagagcagttggtagaagaagtaaaaaagcctgccctgccggagccgaaggagtgtgaactggttgcgcgggagctggcgaaaaaccaggtggagaagatcagtaatgtccgttcccgtctgaatatgacctggcttcagatctggccgattatctgctacatggaagaacaggggattttggaaaaagggaaggaaggtacggtgacactgaccaggacaccggaacaggttgaagaattggtagattcccagcagtggaaacagttgtttggggaagaggaagccaaaagacgcagcactggaagcagccaggaaacagaagaaaagatgcaggtcattcggcgtatccaaaaggagaaacggaacaatccaggtgtgaatgccattaccatagaccagaagctggtatatgaagaaacagagcatcatatcaaaaccaggattccgtaccgtaagaatgaatttatctggctggataaatcggaaattagctggattaatgaccataagacgatttttgcaggattggaaaagaagaaggagtatgcaattttagacctggaggaccgttttcttagaaaaacttcgggggaagatttatatagggaaagctatgacccggtacacagggaacgtgccagacaggagcaggaaaagatacgcagaagaagggagcagaattacaggaaggcacaacagaacctggaagcagggagaagaaccatacaggggcaaaggaggtagagaaccggagcaattcagaaaaagaagaaacagtcctggggcatgtatcttattggtggcatagcttccggctatggaggttatctcttgaacgtgtgttatcagcccggaaaggatatcaattattttttaaaccgtctggatcaggtgatggcagccccgtttgccaattattggaacgaaacttccttaaaagcaatcattctggggatttttgtatatgtgatcggtatggtcatgtatgtaaccagccggaaaaactatatgccgggacaggaatttggtaccgctgtttttgcagatccgaaaaaggtggcaaagcagtttgcggataaagatgaacacaataatctgatcttatcccagaatgtcaggctgtccatgaataccagaaagaccaggagaaacctaaatgtcctggtaatcggaggaagcggcgctggaaaaaccttgttcatggtgaaacccaatctccttcagttaagcagggcttcccagatcattacagatcccaaaggggagattttaagatgctgcggaggtatgctgaaagcgcatggataccggatacgggtgctgaacctggtggaaatggagcagtctaacggatataacccattccgctatatccgctctgaaacagatattgtaaaactggttactaacctgatcaataataccactccgaaaaacgcacagcccagtgatccattctgggagaaagccgagtctttgtacttgcaggccatttttctttatgtgtggcaggagtgtgaaatggagaaaaggaatttccgtatggttttgcagctcttgaatgaggcagaagtccatgcagacggttccccttctgatttagaccggcgtttccgcagactggagagaaaaaagggaagcaaccaccctgctttaatccagtataataaagtggtacggggtgccggagatacggtaaggagtatcatcatttccgcaaatgcaaggctgggattgttacagaacccacaaattttgcggattctggatcatgatgaaatggagattgaggagattgggattggtgttgacggggacagaaaccggaagactgcacttttttgtgtaacgccggattcggataagagttatgcctttttaattggtatgctttattcccagattttccaggaattgtattaccaggcagacttccattataatggaaaacttcccattaacgtgaatttcatgctggacgaatttgccaacgtgccattgccagatgactactgcagcctccttagtaccatgcgttccaggaatatttcatgtaccatttttatccaaaaccttgcccagatcaaggctttgtttgagaaaacctgggaaaccataccgggtaattgtgattctctggtatatcttggtgggaatgaacagtccacgcataagtatatcagtgagtccctgggaaaaggaaccattgataaaaaaagcagtggggaaaccaaaggccggcaagggagcagttcccggaattatgatgtgctggggcgtgagcttttgacaccggacgaaacccgaaagctggataactcagagtgtattttgttaatcaggggttgtgatcctattattgataagaaatacaatacttttgcacactccagattttcggaaacagaagatggcggggctgcgccttatatccatgacagaatggctgcccaaaaacaggcggtacagattttaagtgaagaatccctggattattataagaagaaaaaggaacagggagaagatgttcagattgtggaactgtcttttgatgaaattttttcttatgagcctattcctaagaagattttttcggaggaagagctgaaagagaaccagaagaagagaacggtagaggaggtgaggccgccgaagaaaacggaaaaaccggtacagacagaggaagaaaaactttctgaattattagaaagccatgtttataatgaggaacagttgggagaaatcatgcttgccattggtgctggaatttcgtatgataaaatccttcaaatggcagatacaaaaaacagtgctgaaaagatgaaggaaatccgtaaaaaatttacaaaagaaacagcctcggattaaagaaggcagatttttggaaacctgtagtttttgcattacgcagggcaggttttcaaaaatctgtctttttgcgtaatgcggtatcaatcacatgaaaaggagtaaaaagatatgaagatcaaagaggttatcagaaagaaacagaaccgcttgaaaaaatctctactgggagtcctggcagtaagcgctgccactgtttccctgttcccccagactgtcatggcttccggggtaagtgacgtaacacagccgcttatgaatttaaagacactggtgatcagtattatcggtgcggtgggtgtgattatcctggcaaaaaacgtgatggaatttgcacaggcttaccaacagcaggacagttcttctatgaacagtgccattaaaggaattgttgcagggcttattatggcagccatttcctccgttcttactttcctgggaattagctaaaaccattcttctttttgagataagcagataagaagagaggtgaagtgatgtttaatttaggagaggcgatccttgcacttttggaaatcgtgtttggattttggaataaccaggtcagcctcgtatttgaacttttaggacagtcccctaccgggttcaaaggaggcgggccctgggggatcattgaagggattgaacccctttttgttgggataggctctgccctggtagtcctttttttcgtcattgggttttgtgcagagtcggtagatatccgggaagaaattcggtttgaagcaatcctccgtatgtttatccgggttgccattgcacagtggctggtatcttataacattaccattatgaaagccctgtttacttcctgtggaaacctggtggggcatttggggcaaaaccagagtgtggagttatccattgacccggcgcaggcagaagtgatcaaagatttgggatttggaaccagtatcgtgttcctgatacttgctgttttcctgtctttaatcgttattatctgtggtttcttcctgctgtacaatgtttatttccgctttttgaaaattatggtaattgtaccttttggggcgattgccagcagtaccctggctggaaaccgggggcttagcaatacctttgtagcctatatgaaatattttatcagtgtcgtttttgaggcagtcacaatggcgctggcaatccttttgtgtaaccagtttatttcctccggacttccgacctttaccggagattatgaggactgggccaaaaccctgatttatttgggggaaatgacctttacggttgcgctgacggtaggcactgtaaaaggagcgcagaacctgacttccagggcactgggattgtaggaggaaaggattgtgcaggaaaaagggatacagatgacactatttgaatattttcaggacgcagaatgcttcagccttaaagaagcagtggcttgtgtagaacaggtaaaagaggtaaaagaacccagtatccgggcaagaatttatgagggaatagaaaaggggcttttttccaggatagccaaaggagtctatacggttaccaaagaacaggacggagaagaggtaacttgtatgctggttcagggaaatggaagggatttgagctttttaaaagataacagtatagatgccattattacagaccatgcttatgacctgaaaaaaagcctgaaagggggaaaccgggattttgccgcctatgaatgttttcaatatacgcaggaagactttgatgaaaaataccgggtgttgaaaaaagggtgttttctggtagagttcatgccggaagaaaatggggaaaattatgaacacctctatcagatgaaaaaaatggcgaaagaagcaggacttgaatattatgcaaaagtcgcctggaaaaaaggaaatttcgttgccaatacgggaagaaaatctaaaaatacggaagagattgcattttttacgaaaggaaaagccaggaatttacgcccagatgcgaaaaaggataaggcggagccaggaatatcccactatatgtcaggcgccaggggaatgcttccaacggtctttgacattgaaccgccagggaaaaactcccgtattcatcaggcagaaaaaccagtgcaacttttgcagcagatccttggatttgtaacagaagaaaaggagtgggtactggatcagtttgcaggttcgttttccctgggggaagcagcacttttaaatgaacggaatgcaatctgcattgaaattaatgaagaatattttgaaaagggaaaagaaaggcttctgtctgcaaagagcaggagccggtaagaagggaggatatgtaaatggaacaggaagaaaaactcagcctggattttggcaatggggagatctatgaggtctggctggaagttgcaacttatccggctgataaaaacatcaaagtttgtgtgtttacggaaaaagaggaagagatatggaaactttttgaattgaccacagatatgggaattccgctggaaaagaaccagacctttttgctcccaggctatgatctggagcagatcgtagaatttgtcaaaaaaaacgggcttggacagttaaaagaagaaatttgctgttctggttgtatggaatatccactgtttgaatttcaggaagaaactttaaagaaattggacccggagggatatgcagcctatgagcaggcataccaggaacggggagaagtaaaaaatccagaatttcaaaaggaaatcaaaacagcagattttcaatgggcgtatggaaccgaagaactggcattgcgggtagattattacgcaatgaaccagaacctttatgtggaactgtatagtaaggaagatggggcgtgggaaccgttttcagatttgaccgtaaaccttcccggatattgcctggaacctggaactgcctgtatcagcggtgattttagtaaggaaaatatccaatttattcaggagcatggactgggaactttgcttccctggaaggcacaatccggtatggggcagtacgcggtggtgaaatttcatctggaggagctgcgtaagtttgaccaggctggggttgccgccttttgcaatcaacatggattacagaaaaccatgcaggaagagcgaagacagagcagataaaaaacagatacaggaggttatgtatggagattgaattaagtgaggacctacagcattataaagaatccctggttctaggacttacagcaaaacagtttttgttttcggcattggcattgggcgtaggaactgggattgtcctgcttttgtatgaaaaaatcgggattactttgagctgttatgtggcaaccccttttgttgtacctctggcactgactgggttttataactatcatgggctgacattctggcagtttgcagggaagatgatttatttttccttttttaaccgccctttggtgtatggctctacggaatcggtgcaggaactgaaacagatttatatggaaacccgtcaggaagaagaacgggaagtacagcaaaggaaaaaggaacagaaaaaagagaagaaaggtggtgatgtcaacgtggtgaaaaagaaggcaatccgtatgggaatcgtaacggtagtgatgattgtacttggtgcggcagcagcggtgtggtataagatgtaccgttgaccagaatattcaatcaaggcgtgaaatagcgcctgctctccatttcaggagagggatacacagacatgtagcggcagatggaagctgctgtgtttgtggtcccatctgcctgaaaggaggaaattagagattgtcaattttttcagataagtttgaccagttaaaaaaagcagataaagcagtaaaatccccgaaatatcttcaggaagtcatggggattgggagaattgcagaaaatggcatttttgaagtagggaaggggatatattccaagacatatcgttttttggatattaactatgtaaccgcaggtgcagaagaacagatgcggattttaaagcagtattgtaagacggtaaatgccattgatgtatattttcttattaccatttttaatcggaataaaaatatgcaggatttccgggagcatgtacttttccaggaaaaaggagatggttttaactggctgcgtggaagttataaccagattattgaaaagcgcattgtagatggaaggcaggggattgagcaggaaaaactgctgactgtatgtgtagaacggaaatcctacgaacaggcaaaagcattttttgccacttttgaagctaccttaaaacagaactttggagaacttggttcctgcattgaagaattaaatgcagaagagcggctgcgggtacttttcaatttttaccgtataggggaagaagaacaattctcctttgatttcagacaggcgttaaaaaagggcggtgatcctaaaaatgatatttcaccagggtatatgcagttttacccaggttattttgaaacggaacggaaaaaatgcagggcattattcattaaaaaatatccgtcttctttatcggatacctttttaaatgagattactagtcttccggttcatagcatcactacaatctgcattgtaccagtaccaaaagaactggcaaataaggttcttcagaagaaatatctgggcattgaaaatgatattttaaagcagcagagagtccgtaataaaaataacgacttttccagtgacatttctcatatcaagaaagtccagaaggagaagattgtaaatcttatggacgacgtgcgggaaaatgaccagaacctgttttatacaggggttaatttcctgatcatggcagaggacaagaaggagctagacagtgtaaccgaaaccattaaaaatatcggcaatggacgcatgtgccagattgaaacccactattatcagcagagggaagctatgaataccatacttccagtgggaaaccggcagatcagcacaatgcggaccatgctcaccagggatattgcagcccttcttccctttaatgtacaggaattaaacgaaaagtccggcgtctgctatggcattaaccaggtttctcataacctttgcattggaaaccggaaaaaactggcaaatggaaatggaatggtattcggtgtccccggctccggaaaatcctatttcagtaagtcggaaatgctgcaggtgttcttaggaacagatgatgatattatctgtatcgatccgacactggaatattttgatattgcagaagccctgggaaaccaggcggcaatcattaacctgtctacctatacaaagaattacatcaatcctttggagatggatgtctgggcgctggatttaaacgattcccagggatatatccgagataaaggagaatttatgctggggctgtgtgaacaatgttacggggataatctaaacagccgccataaatccattatagaccgttgtgtacgaaagctgtatatcgacattgcaaaggcaagggaaaagcatatccctaccatgtcagaattttatgagttattgttggagcagccagaagaagaggcaaaggacattgctttatcgttggagctgtttgtaaatggctctttaaatattttcaataaccataccaatgtgaatgtacaggcaaggttcattgtctatggtaccagggacctggggaaagagctgggagccatttccactctggtcatgctggaaaatatcagtgccaggattgcagaaaacgcaaagaaaggaagggcaacctggctttatatagatgagttccatacggttcttgaccgggagtatagtgcgaaatttttgttcagcctctggaaaaaagtgaggaagcaagggggactatgcacaggaatcacccaaaatttggttgatatgctgcagaactatacagccatgaccatgctggggaacagtgagtttattgccctgttaaagcagtccaatgtagacagtcaggaattatccactgcagcaggaattccagaagcacaattaaaatatgtagataattctccttccggtacggggatcattaagtatggaaatacctgtattccatttgataaccgtatggaaaaagaagccaatccgctgtatgcgcttttcaataccaaccttcacgaaaaggcgttgcagacaaagcaggagtaatgtaatctgaaaggaactttttcttttatctgtaaaggaaaaggtatgacagacgagaaaaaattaggcaacagcaaaaattataagtcggtaaagtagaaaaaggataggacaaaaagagtgcagttcttttatcaggcactctttttgtatatcatgggaaaggtggcagaatggctgaaacatatcaaatagaaatgaatttagaacagttggaaagacttttaaaaaatctgccggagggaattatgctggagatttgttttggaaaggaagaacatggagaagacacataaaatagatgtggtaagtatacgcctggtggaagaacctcctctatacagtagtaaagaattaaaaaatccctgtgatgtggcagaactctttcaggattttttaaaagattgtgaccgggaaatgttctgtattttaaaccttcggacaaaaaaccaggttattaatgtcaacgtagtaggtatgggaacgttaaatagtgtactggttcacccaagagaagtattcaaatctgcgattttatccaatgccagcagtatcattttggcacataaccacccttccggtgatccagaaccaagcaggcatgatatagaagtgacaaagcgattggcagaagccggcaatcttatggggattgaggtgttggatcatatcgtggtggctgagaaccggtattttagtttcagggaagaaaacatactaccagaatactttcaaatggaagaagtagcagcagagcaatctcttccttatgtaaagagtgagaaagagaaggtacattaattattgcaacagtgaaatacattgactggttttgacagaacatgtataataaaataagaaacagaaaataaaagtagctaaatagacaaatagacaaatatcgtcaaagtgtaaacataaaattcttgacgaacaggttgtattatgctataatcccaaatcttgaaggagtatacatggcaaagaaaaaagtttatgctgtaaaaaagggtaagcaaaccggtttgttttattcatggaatgagtgtaaagagtcggtaagtggatatccgggagcagagtataaaggttttgaaacagaagaggaagcgaaaaactatttagagaataggatacaagaaattaaaaaagtagatatagaagagaacacaacaaaccagttagttgtatatgtagatggtagttttgatgagaaaataggaaaatatgcttttgggtgtattattcttacaccaagaggagaaactattagagaatcaggaaatggaaatgaaccggactctttagcaattagaaatgttgctggtgaaatgcttggtgctatgtatgcagtacaatgggcaattaagaatggttatcataacttagaacttcgttatgattatgaaggaattgaaaagtgggctcaaggagaatggaaggcaaagaatacacttactcagaaatatgcaaattttatgaagagtaaatcagatattctaaaaatttcttatcaaaaggtaaaagctcattctggagatcattataatgaagaagcagataaattagccaaagctgctttaacagaaggtaatgggattcctaaagttaaaagaggcgatttttggtttacagttgagggaatttcagatgaagatttgtcaacagttatagcacttgctgttgatgaaattggaaaagacaatctaattatagatgaaaaaaagattgctcatggaaaagcagtttctttaaaatgtaacaaaagtaaagatagagtagttgtgacacattatcaaaagcataataaagtagtaatgcaaggaagaccagaagtgttattttctactattattggatatattactgaattaatagaagtagaagaaattcctaaaatttttaatgacacatataatcttaacatagataaagacgaggttcgctctgaatttcagttttatatgccaaatgcttatgataagctaccgtctaagaaaatggaaagatctcttcatcaggctgtgtataatttaaaggtcacagatgatatgtttgatggaacatatttggctcagccggcaattcgtgttgtagaagcacaattaaaaatagcattaatagaatgtggtattataccaaatgcgcagtacatcaaagaaaatcattttgatatgtttgataaaataggtgtaaaatataagctgaaaccagagagatatggaaatgcaaagcctgagcaggtaaagtatattggaaatatttatacgttttataacagcaatcgccatccaatagaacattgggatgaccctacagcaccaattgatactacaaagatgctggatataaaaggtgctcatgatttgattaaaagagcattggcgattattgatgaatattatgaagtgatttagaaattaggagaaaggagtaagttagatgaataactttgatatgattgtgataagtgaagaaaaagaaaatattcttgtggttatgaagactagcgagcctccttttgattaccttgcagagattgaggcttcgctaagggaaaaacactatatcggtgtagtaatgattgatgaattgctacatagtgggaatacggaagaacggttcattcagggatactttgatggtgcccggtttgacagtgggcaatttgcctttgagcttgttccgaaaaagagcaaattaagggaacctgtttgtttttacttgcatcaagacagggaaagccttgaatattctattttaacgaccagacagcagaagctgattgagcatggctgtatcatttaaaaagaaaataagaagtaacacaaagagcattatcgctaaaaacggtagtgctttttttgtgcataaaaaggaggtattgctacgtggaaaaaggtgagatgggcgagaatgccaccggacgtttgacaacgtattatgtggcagaatgtatggaatttaaccgctatggagaatacagggaggatatccacagtgcagaagaggcagtaaagatctatcagagtattccttctgaaaggttgaatgcaggaaaaggaattgggcttcatgtggaggaagaagatggtattccattggaattctccttggtttataacggggagttggatgtggatcttttgagagatatctatgatcaaaaccaatacccagaggtttttatagctgccagggaactgagtgcttatcttccggaaacaaaagtcattgataccaaagggcttttaacagagaaaaccttggaggctactgtttttgcagatgaaatgattaaactggaaaaaaatcttgaccctgatttttaccataccttttatccgaaagaagcagaacataaggaagctattatatggaaagccttatgtcaagacggaaaagaggaatacagcaggtggctgggaagcaagatatttgagcagaaatcagagttgaaagaacaggcagacaagctaaagacaacactggaacaggtaaaacttattccgccggtggacttgaaaccctttgtgtatgtgcggatcagtgaacacccggacattccattggaagaagccatgccattaaatcaagcggtagaattgttcggaaagctggatcggcaggcagtggaagagaaagatatggcaggttattacaaaacacattttgaaatctgttttctctcagagggggaagtcatgtcttataccgggcgccaggattttggtgacggggaaggaaatctgctggatcatgtaaaagcatttgcagattattatctccatacagaagaagggcagcagcttatgaaacagaccgccaggacaacagaagaatgggaacatgaacaacagcaaatgagatgggtactggaggagatgcttcctacccttcagtatttctgcaacctggaaaaactggaaacagcggttctggaagaacaggaaatagaaaagaaagtccctttactgacgcagggggacgcatcacgaaaagcatatcaggaagccatgcttgcctatatccgggaaagcaggattgcattaaatacagggaaggagctgccttgtatgccggatatcctggattttgcaactgcctgtccggataaatcatacaaagaacaggttatggaaaagatacgacaggaagcagagtcatacggtatgaccgtagaagcgtatgcagcaaatggatatgagccgccaaaaaggggcggcagataaaattaggaaaggaggcggagttttggccatgtaaaagatatcttccctcctgaaaaaaattggatttagaaaaaacagcaatagaacgtatccgcactgccagccagatgtccctgcaacattatgggcttcctttggtagtgacggacagtggaggaaaagacagcgccgtatgcagggaactggtacggcgttccggcgtgccatttgaactgatgcacaacctgactactgcagatgccccacagactatttattatgtgagggaacagtttcagaaggcagaacaggccggtataacttgtagtatcaataaaccttactataaagggcagcggataactatgtggagcctgatccccatgaaaatgatccctcctaccaggactatccggtattgttgtgaggttctaaaagaaaatggtggggctgggcgttttatcaccacaggtgtccggtgggcagaaagccgaaagcggaggaaaaacagggggatttatgaaaactttgtcccaaatggaaaaaaacgtgccattattttaaataatgataatgatgataccaggcgactctttgaatcatgcctgtcaaggggcaaacacgtatgcaatcccattgttgactggagtgaccagcaggtctgggagtatatccaggcagagaaaatacccatgaaccctctttacgaaatgggatttcactgggttggctgtgtaggctgtcctatggcaggaaaacaaagataccgggagttccgcatcttcccgacctatgagagggcttaccggcgggcttttgctaaaatgctggagttaaggaaagctgcaggaaggcagtgcaattcccgcttatggtcagatgtagatgcttttttccgttggtggatggaggatcctggtatccccggacagtatgaattgtcctttcatgaagataccaatgagatttattatgactatttgtagtggaagggaggaggaattatcgcaaaatatcaattatcttttggactgcagtatgaagcctggatgctggaaatccgtattccggactggctggagtttccttctaaggagcaggcactaaaatatggtgagcaagctgaggtttccgttttcttaaaagcggaagctatttttttgctctttgatggcagtaaggagaagattttaccgcagcagacggaactttatcagttttcctacctgaaagaaaagacttatgacagactgggaccgccactttccccggaagacatagaccatttggtagaagtgggggaattggagcaggtactgttcagtgaaaaatatatcctgacagaagatgattaccaggaattttccggaaaccttatggaagcctttcaggaattggaaaaggagtacggtccaccacccagagaaaaggaacaggggtatctgtttcaggcgctctggtatcaggcagaagaattaaaccccggagagggggactgctttggagattaaggtaaaaaaagaaaaagagccggagctgaaattaaaaaaagaagcccaggtgacggtgcataagaaaaatcctattttatctgcaaaggaaaagaaagctgcttttacctctaagccggtggccgatcttttagggcagagaaagaaaaaagaaggggcagaaaaagggaaacagccggagcagggcagagaagcgctgtttgaaaaacaaaaggaaaagaaaaagcaagccgggaaagaggcagcaatccggggagcagcagaagatagaaaacaaaatggaaaggccaaaagcaccgtatctgtaccgggaaccttacagccggatcagatgaaacagggggtagcaccaaacagtcagccctctgctggtttccaggcgaaggaacagtatcggagggaacaggctgcaaagctggcggaaacaaaaaaatcttccctggcgaagcagactgccataaaaggggtacgccggggagaggctgctatattgacccagttagagggcggggaggaagtcaatgattccctttatgtcatggggacagcaacaaaaccggcagaaaagctgtggaaggatcggaattatagaaaggcagagcaggaattaaaggtaaaacaggcagatgggaagatcaccaataagcagttttacagacaaacaagagcagtgaaaaagaaacagatggagaaacagaaaaaacaggcagtccggcagagaaaaatccagtatatgatcaataagctcaccggaaatgggcagcaggacagtttggcacaggtggcaaaagatattgtaaagatgaaagcctctgtgtttatgctgaaggtggtccagtttgccggggcgcttttggctccgctgttcagtattcttcttgtggtggcaatccctgtagtgattatctttttcctcttatactgttcgccacttggtgcgttcatgccaaatccgtctgaggagaaccctaccgtccgagaagttttaagcggttactacatggactttaatacaaaacttggacaaaatggggaagatggggcagttacctatctccatgagaaaaacgggaattatgtgagtaattactatgatactttaatggtttatatggtgaagtatggaaccggggatataggtgtggatatggatcagcggcataaggacaagctgaaggaaatctttgatgaaatgaacagttttgaaaacacgaccataaccaccaccataaaggcaggggaaagcctgggaaatgttgtcaccagcggttattgccagtgcagtatctgttgtggacagtgggcaggaggacctacagcctccggtgtcatgccaaaaccggaccatacccttgcagtagatgcacaaaacccctttgtccctatgggaaccaggatcattatgaacgggattgaatataccgtagaagataccggagcatttgaccggtatggggtacaatttgatgttttctgtgcagatcatgcaactgcgtctgcctggggacatcagacttttgaagcgtttctggcagatggggacgaaaatgagattacggtaacaaagaagggctgctacgtcaagaacctgaattatgaggactatattgcacttggaaagctgaccgaaaaagaagaagaacttttaagggaagtcatgagtgaggaattccgaaatgagatcccttcctttggcgtaggaagtgacgttgcaaatctggcactgacgaaggtaggctgcaaatacagtcaggaacaccggtatgaggaaggatattatgattgcagttccctggtacagcggttgtatcaggaggtaggcatttcccttccggcgattgcctctacccagggagaatttatggtaacacatgggttggaagttacagaaggcgaactggagccgggagatctgattttttactcttatgagcagaatgggcagttccgcaatatttcccatgtggcaatttatgttggtaatggcagaatggtacatgcagccaacagcagacgtggagtagtgaatgacccgttcaatccgtcgaacattgggctgtatggaagacccagccgcttgcagtaagaaaggagaagcatggacgaaaaagaatatgaagtgaccataacagaagtcctggagaaaaaagtaagataccggggcaggaatgaactggaggcaactgcaaaagcagaagcagattattatgcagaaaaaatcgtgctgggggcagatgatttttcctatcgtgatatttctgcaaaagaactggtacctgtaaaagaaagaaggaacagcagatgaagcatatcacaaaagtacgggaactgtatgaggaaaccatacactggatttcagagtcggaggattcctggaaaaatttcctttcctgcatggggcgtttgtatcagttggacttcttaaatacctgtatggtatatgcccagcgcccagatgcgtccgttcttgcaggatatgatgcctggctggaaatggatttgccggttgccagaggaagtaaaggaattgcagtatttccttccaaaattttcggggaaggagttacccatgtttatgatattcaagatgtaaagggacagggaatccggccctggaactggcaggtgaatgggacaaaccgcagactgctggcaagggagctgttcccggaaatctacgaacaggaaaaaaagtttaaaaattctttagacgcctttacaggaacaaatgtttggtttatgatagaagaggaagatgaaattttaaaatccttgcagaagctggctgtccttatcggagagggacaggaggtaaaagaaaaccagattacagagtttcttgtaaacagtgtctgttatgcggtgaaaagccgctgcggtatccgagatgacaccctggatttttcttttatctgcggtttttcagagaatgaggaggttctgtaccggacaggacggttagtatcccatttatctgggcggattgtgttacagattgcaaggaccatgaagaacatagaccttgaaaggaggcagtattatggaaggaatcgcaggaatccagtacagggaaatgaatggcgtacagataccagtcttagagggcgtgatgagcgaggagaagatgctggcgtccctgaaccgttacggcaggatcgcagcacaggaaatgaagagaacggaccaggcacaatacgaaatgatgctcctgtccgggaaactgatggagcggcttatgaaaatccagacagaagcggaggaataccacgagaaactggcagaaagttttctgaagacctggaccagggaggacaggatagacccttacaacacgttggaaatgaccaaccttcggatacaggcggatatggaatcacagaaacaggttatggaggagatcattcagctcaggatcggataaaacaggaaaaaacagaagaggatacagagaaaggaactgcttcggcggttccttttctgtctggggagatagaacctgcacagccggaaaactggcagaaagagaaaattcttctggaaatgacggagcaggagataccatataaaatttatgagttttaccggaacaatccagaggaaacagaccgggaagcttatctttatgaattgtatggagatgtaaaaagagaagcccatacaaaagacggtatcctgaccgcagaaagcggttccagtggtttttatatcctttggagtgagggaacttccatgaaggaggcgttctggtactgggacgaagtttctttggaaattgggaaacggattgaaaaagggacctatcttcctttgttatctgtatcggaggaagccttagaaaatggggaagaaacagaggaagaaaccttacagccagagaaagtgcaggaagtgattgaggaaaaggaaccaatcccattagaagagattggcatagccttttataaacagaatatccaggcggatattttaaagaaaatgctctgtctggtctatacgaccaatcagctaccggaagaaaaagaccattttttgaagatgcttttgcttcgggaagtaccggaaggccagccttattatctggtgcggacagaacatggaagctatgagctttgtattcaggaaaatgggattaagatcaccctgccggaaagccaagattttctgcaggaactttcctgggatcagtttggcgggcttactgcacatctggcagaggaggaccagattgcctataccgaagattcagaaaccttagagcagcaggagaatatgtaccgtctgcttccctggtttccggcattatgggaagaatatagcgaaattcttaaaaaggaagagctttggcaggaaggaagaacctctgtccagacagaaggcaaggaagaagccggagattattattacccagaaggggggttgcagtttaccggtggggataaaagccggtatcagaaaaatatccgggcaatccgtatcttaaaaacactggagcaggaagagagaaatgccacaaaagaagaacaggaaattcttgcggggtatgtagggtggggcgggctgccaaatgcttttaacagtaaacgcccggagtggaaaaaagaatatcaggaattgaaggaactgttgaccgcagaagaatacgcccaggcaagggccagtgtcaacagttctttttatacgccgccggaagtcgtgcggggtgtttataaagccctggagcagtttggattccagaagggaaaaattctggaaccggctatggggattggaaacttttttcatggtcttccggaaagtatgcaaaaatcccagctttatggcgtggagattgatgccataagcggaaggattgcacaaaagctccacccttcagccagtatccagattaaaggatttgaaaaaacggaatttgaggataacagctttgatgtaattgtaggaaacgtgccttttggggatttccgtttgtatgatccccgatataaaaagatgaagttgaaagtccatgattattttatccggaaaagcatggacctccttcggccaggaggcattttggcagtggtaacttcaaaagggacgttggataaaaatgacagcgctgtgagaaaaaatttggcagaacaggcagaccttttaggggcagtccggcttccggcagattcttttggaaagagcgccaataccgcagttaccagtgaccttttgttttttcagaaaaaagcagagccttcgattggggagccaatctggacttatacagggcttacggaagacatggtaccggtaaatgagtattatctggaacacccggaaatgatgcttgggaaaatggtctggtttgaacagtttttcgggaaagattccaaatatacagccctggtcaatgaagcggaagactttgacctggaaaaaagaattttggacgcagttggagagcttcctaaaaactgttatgaagaaagcatagcagaaaaaaagaaggaagagcaggacgtcttagctgcttccccaaagatacctaattatacgtttacggtgatacaggacgaagtatattaccgggaaggggagtctttataccggagtcaggcaaaggaaagtgtgaagcgccggatacgtgccatgcataaaatccgccttctggtgcgtgaaattttacagatacagcaggaaaattgttctgaccaggaactgaaaaaggcacaggaacagttaaaccgtttgtatgatgcctttgtgaaaacgcatggatatttctgtgaccggacaaataaaatggcgttccggcaggacaatgattaccccctgctatcttccctggaagtggttgatgaggacaaaaacgtaaccaaagccgatattttttacaaaaggaccatacgccccagagatgtgatagacaaagtggaaaatgcccaggaagcattgcatatcagtctgtcagaatataaccgggtggatattccctatatgctctctctttatctgggaaacaggaaagaaatgctccaggaattaaaagggttaatctaccagaacccggtactggcaaaagaagaagatcccaatgcagggtgggaaaccgcagatgagtatttaagcggaaatgtgcggcagaagctccgtactgctaggatttatgcgcagaacaatcccttgtttgtagacaacgtggaagcactggaaaaggtacagccaaaagaactgacagcgcctgagatcagtgtaaaactgggaacaacctggattgaaaatgaggattacgaacagtttatatatgagcttttggaaatcccggagagcaaccagagaaactattgcgctcatagtggccatgccctcaagattgagcgcttagatgcagatatgtcttaccatattgacaggggaaatttttttggaggaaccattcgtaccagggaaacctatggcacaagatttatggatgcgatcagcattatagaggaactgttaaacagccggattgtgaccatacgggaccgggtgcaggaaggggaaaaggtgcgttatgtgattaatcggaaggaaaccatgcttgccagggataaggcggagcagataaaagaagccttccgggactggatttttaaggaaccagagcgcagaaaaaaatatgtggatttttacaatgaaacctttaactgcgacagacaacgaagctatgatggctcttatttaaaactgccgggactgaaccctttgttaaaactgcgtccttatcagaaaaatgctgtagcaagggcattgctgtgtggagggaacaccttgcttgcccatacggtaggcactggtaaatctctggaaatgatctgtatctgtatggagatgaggaggctggggctggcaacgaaaccccttcttacggttcccaaccacctgaccttccagatgggggcagaatttttgcgggcctacccagatgcgaagatcctgattaccagaaaagaagattttcagaaggaaaaccgcaggcgcatgattgccagaatggcaacaggggattatgactgtattattatcggacatacgcagttccagagaattgccatttcccctgaccggcaaagagccatgatagaagaacaggcagagcaactggtagaagccattaaccaggcaagggaagaagcaggaaagaactggtccataaagcagatggaaagcagaaagaaaaaactgttgcagaaaatcgaagaactgaacaatgaagaaatcaaagatgatgtgatgtactttgaagaaacaggcgtagatgccttatttgtagacgaagcgcacctgttcaagaacttggaaatttttacgaaaatgaacaatgttgcgggtctgggttccagcggttcccagagggctatggatatgcgtatgaaaatccagtatatcaacgaaaaaaatcagggaaggggcgtcattatggcaacgggaacccctctgtcaaactcaatggtggaactttatgtgatgcagttatatctgcaggaaaggcggcttcacgaaaaggggatttaccattttgatgcatgggcttctgtgtttggggaagttaccagctctttggaactggcaccggaaggtactggttaccggatgcggaccaggtttaataagtttatcaatctgccggaactgatacacctgtttaaagaaatagcagacattattctgcctgatatgctagatattaagcggccagaattaaaggacggaaaatataaggttgtagtatcggaagcctctgattatgtcaaagaacgtatgcaggaaatggtggaaagggcagaagcaatccatagaggtgtggtagatccaaaggacgacaatatgctccggattaccggggaagcaaggcttttgggtacagatccccggcttttggacagttatgctccggtagattcggattccaaactgaataaagcagtagaaaacatttaccaggaatatgtacagtcccaggaacagaaaggaacccagattgttttttcggatattgggacacccggacctgggaaagcgtttaccgtctatgattatttaaaacaggaactgattaccagaggtgttccagaggaagaaatctgttttatccatgatgcaaaaacagatgaacagagggaccgtatgttttccgatgtcagagccggaaggaaacggattattataggaagtaccgaaaaactgggagtaggaaccaatatccagaccagaatggtggcggcacatcatatcgactgcccctggaaaccctctgatattgaacagcgggaagggcgtattatccgccaggggaatgaaaatgaggaagtcaatatttaccgctatgtaacaaagggttcttttgatgcttatttatggggcattgtagaaacaaaacagcggtttatcagccaggtatttaccagccgggaactggcaaggatctgtgaggatatagatgaaaccgtactaaactttgcagagattaaagcggtagcttctgaaaatcccctgattatggaaaaaatacaagtagataatgaagtggcacgtctgagaattttaaaagctgcacatgaagggaaacggtttgctttgcaggatgcggttacgttccagtacccgaaaaggatacaaagtctggagaaagaactgcaatcgcttcaaatggatttggaccgtaggaaccaggctatggaagtacagccggggtttgcaatcacgctgcagggaaaagtctatgagaagcataaagaagcaggggaagtcctgcgtgggattatagaaggtgtgacagcttttaccaggcacgaagtcggtatgtataagggatttcaggtatttgtccaaaaggatatgatggagccggtattgttccttcagggagagaaggaatatagtgtggagttaaaaagcagtgactccggcaatatggtccgtatggaaaaccgcttgaatgcccttgataaagcagtagaagatgttcaaaaagaaattaagacctgtgaaaatgagataaaaaatgcaaagcaggaatatgcaaagcctttcccgtatgaggagcttttaaaagaaaacattacccggcagatggagattgatgcagaactggaaatcaaggaccaggaggagtgtgtggaagtgcaggaggaaaccaaaaatcttccatgccagacagcggttcggtaaagaaaagtagagtagaaaaggagatcacaatatggaatataatatcagagtatataaaccggaattgaaacaggaagaaggaaagatcaataatctgaaaggatttgctaccattacctttgatgaggccttctgtgtgaaaagtcttgcaattaaagagtcctcgaaaggaaatctgtacctcgatatgccccgttacagagattacgaaacaggggagtatgttcctttttttcggtttaccgataaggaatttcaaaaggaagtgttggatactgtaagggaagcctatgagaatatgacagaaactaaaacagactgtaagggcagttggggagaggaagaactgtattacaatctgagtgtaaatccggtacagggaagcgatacctttaaggcagatgttgccattcgtctgcaggacgtattggcaatccagcagcttcatgtgatccaggcatggaacggaaaaacctttgtaggtatgccccagaaaaattctgcaaaaggagaacgggaggacattgcccatgcagttaatgcagaatttaaggcagatctggaaagtgcaatcatggacgaatacaataaaaagatggaatatgccaaaagccagaaacagcagcgaagaaacgggaggtaagaaaagtccagaaaaatatatggtgttttccgataaagagtgatacaataaagaaaatatcgtattaggaggagcagatatgccaagacgcaaaaaaatggagaatatatctctggaggagcagctagtaactgtagaacaggagattaaaacaacagaggcagaattaaaagaactgcgtctgaaagcaaaggacctcaggaagaaaatcgaagataaacagaaagatgagatatttagcgcattgattgcttccggaaaaactgtggaagaggtaatgaagtatttaaaatctggtaatgaagaaaaggctgaataagataagagaaaatgccgttacgggtgatgataaaaacctgtagcggcattttttatgtaaaagctttgaaatttcaaatattagtttactacgaaaaatgtgatttactatattttgtttgataagtgatatttgtgggagaaaattatcatgaagtgctaaaatggtaattggctaatgaatatataaaattgtttgtaagaattgaagttggcgtaaatatggaatataatagttatatcaaacaaattcaatattatagaaatatgaaaagaagaaaagttcatttcaagtacaaaaactgttatgcgacaaaatggaggtgaaatatgtttactattttaattgtagaagattctaaagaaattttagatttgatggttttacatttagaagataaatataatttaattaaagcagaagatggcattaatgcaataaaaattgctaaaaaagaaaaaattgatttgcttattttagatattatgttgccattagtaaatggttatgagtgtatgaaagcaataagagaaaaaaagaatattcctattattattgtatcagctaaaagtacagatgaagataagattattggattgcaaaaaggtgctgatgattatttagcaaaaccatttaatccattagagttggtagcaagggtcgatgctcaacttagaagattttatgaatttggtagtgcagaggaaattcaagaagaagttatctgttttcagaatctaaaattggactgtaaagaatgttgcttatataaagatgaagaaaaaatatgtttgacaaataaggaatataaacttttgaaattactgatgaataatccaaaacgggtttttactaaaaaggctatttttgaagctgtatgggaagacgagtatttatatgatagtaatacaataatggtttatattagtaaattaagggactatatagaagaagattctaaaaatcctcagtttattattacagtaagggggttaggatataaatttggaaaatagaaagaagaaactagaagtaacgcttataaaaaacttttgttttttttcaatagtgattgttattatatttgcaatcgtggcgagtgtaataagtgtatttaataactcaaaaattgttaatacattagaggaaaagtatattgtcagttgtgagggaaaaagccgatatgaagatatagatatttcagagttaaaaagaaatggtgcatggtttgaaatattgaatacagattacgaaagacaatatccgagagcagaatataaaaaatacactagcatagaaattatagatattgtaaatggtaattatgaaattgatggaaaaaaatatagagggattgttaaaaagttttatgatgaacagaacagacagcgaatacaggtaactttttttccgatagatttcttgcgagtaacgccaaccataaacattcctttagaggcagaatcaattcactttttagggatttatatagtaggtattattttatttggaattgggtattgtttaaccgttttttgtgtgtctaagaaaataaaggtagaattgaccaagccaatcaatttattaaaagaagcaatgaaagaattaggaagtgggaattataaaaaaagactatcttttaaagcagagtatgaatttgtggagatggcaaattcttataattgtatggcgcaagaaatggaagatgctgtaaaacaaaaagaagaagaagaacggttgaggagacaattgatctcggatattagtcatgatataagaacacctttaacagttgttcaaggatatttactaactgttataaatgatttagaaaatagcaaaagtaagaacatagaatatttgaagcgttgttttgaaagcagtgttgaaatggagcagttacttcagcaattaagcgattataataggatgtttcgagtcgattacaaattaaacaaagaattagtggattttactgagtttgtgaaaaatattttggcagatcaataccattatattgaggtaaataaaaacattttgagagtggaggttgatgaggaggaaagaaatatcttcattgataaaagagaaatgcgtcgagcaattataaatttactgaataatgcagtacaacataatgatgaagatacgactattgaaattagactgacagaatatgatagaaaaatatatcttgttatagcggatgatgggaaaaaaattccaaaagatattagttcgtgtatgtatgaaccatttgttaaaggagatcaatcgagaaatgatagtagtaatagtggattaggacttgcaattgtaaaaaaagttctggatgcacatgaagcagctatttattttgagcagccatataagaaatatacaaaggcatttataattgtgatgccagtaaaataacataaaaagcagggcattgtgccctgctttttatgttattttaaggttcagataagatgaattttaaaaaagcatgatatagtaataccatcaaaacaaagaaagacggtggtcataatgaatgaggcactttcgattgataatttgacaaaaaaatataaaaacaaaatagcattggatgatttttccatgaaaataatgccaggagagatagtggcacttataggtgaaaatggtgcaggaaagacaacattattaaattctatttgtggcttcattagacctacttctggaagtatatcttttaaaggaatatctagtgaaaaggaaaaaacattagataaaataggagttttaatcgagcctagttttttggattatttgacagccgaagagaatttacagtatctatcaatattatcagaagacaagaaaaatagtactttaatagaaagtctattgcagaagacagaactttctgatagcaaaaaaaagaaagtgaaaacattctcttttggcatgaaacagagattgggattgtgtcaaagcctgttaacagatgtggaattattgatatttgatgaaccatttgtaggattagatccggttggaaaggaattatttaaaaaggtaattttagataaggcgcatcaagaaaaaatccccgttttattttcgagtcatgatttagatgatgtggaagaagtatgtgacagagttgtgatggttcgaaaaggaaaaaaggttttggatcagaaattagtgagagaaaagacttttattttaaaaattgatggaaatataagcacagaagagaaaaaaaagttggagttacaagatcccactatactttgtgaaaaagattgtattttttttaaaaatgaaaaaaatattgttgatattcaaagaatattattacaagaggggcattatatcgtgggaatgtcaattcaaaataataatttgaaaaaattatttttggcggaggaaacgatatgataaatagaaagcaggtagtttacaaaacagaattatataaattgtataaaagaaaagatacatggatttttttaacagtgattttagttccgattttatatagtgtaggaattgcaagtggttcagaaatagtttcttatagcggaaatggaaatattacagcaatcaattttatatcggcgatgtttcaaatggctcaatccatgtttatttttaatattattttagttgccattacaagtagaacattagggactgaaattgaagataaaagtttacggatttatttgaataaagtaggtgatagaaaaaaaatctatatagaaaaagtaaaggcattaagcgtgtatgctggtgtgattagtgtattattagtagttgtaggattgttttgttattattttataatgaatgataaaactccaattgtaaatggagcgttgtatgatgaaagaatttcaatagaaattatacagattattaccatatatcttttttgggtaataacaatttttatcattatgatgttatccataaagtatagattagtagtctgcttggggatttatatgataggctacattgggatgaatttactttcttatacgaaagtgtttaaatatttttccccattgtattatatcaatacttttacaatgatggaaaaagtagtatggacgcaggttttaataggagcaatttatttttctattatagcagtttttaccacttattttggaattagagaatttagaaacaaagatatttaatttggaggaagatatggactggttgggtaataatgtaaagacattcaaagtcaaaggaataactattatagcaaatcgaaataatggaatggtaattggattagacagggaaggggaagaagtcgtagatttattaaagagcaatcttatagagatttcttcactatctgataaccagaaagaactttataaggtcttggaagaaaatgattttttgaaaagctgttacaaggaaataaaaggtattgactcagtatatttacatgtcaattctgcgtgtaatttacattgtcttggatgctattcttatgtagaaaatcggaatacaagaaatgaattaagttttgatgaatggaaatgtgtcattgatgatttatcattacttggagtgaaaaatattgtaatttcaggtggagaactatttctgagaaaagacttacgagaaatttgtaaatatattaaagaaacagtaaatggaagcttagaagttatatcaaatggaacgatgaacatctctgattatgaagtggttttgccgtatattgatgcacttaacatatcaattgatggatatgatgacaaaacatcatttataagagataaaggtattatgaaacgtgtgttagatacggtagaaagactaaaagaaaagataccgattaaattgattgtaacattacataagaagaatgttccattcatgaaagaatatgaaaatttagcaaaaaaattgggtgtatttatgagtttcagtatatttacagtggattttagcgaaaagatttttgaagattataaattcagcgaggatgattttgttattgtcggtgataacattacagagtcagaaaatggaactacaattttagatacacctacagatgtggttggcattacatatcgggaaggttgtggctttggaaagaaaacgattagtatagcatataacggagacatttatccgtgccatatgctacattgccaagaatgtaaaatgggaaatataaaacatggcaggttaaaggatattattgatgagtctgattttgaaggaaataatatattattagatgatatagaagagtgtggaatttgtgaatacaaaaatttatgtggtggagcatgtaggggacgagcatatctatttacaggcgatatgaaaaaaagagatccttattgcttagcagcaaaacgattttatgataatctttttgcacaatatacaagtatatagtttttataattatataaatttctgagaaaggaggacgtaagtatgatctttaagagtgggaaagcaaatgcaggttgctggtcttttggtcctgtattaggattatgtgcaggatacggaaataaaaagggctggtaagaattatgacagcaagaggagggggaggttaaacttcccctttttcttattaggagatataagttatggataaaaaagaaaaattacttatagaaatagtttgtattattgttctgagtaactttttatgtatgttttgctttttattcttaaatttggcttttcaaggaaatatggaggagctggcaagtattttgtcactcgttatcagttttgtgattatgccattttatgtactaaaaaagcaacataatattaaaatctcagaaataggaatagcaaaaattggtataacagatagtatttttttaattagcgctgtgatttttagtgttttcttatttataacaaaaggaaacttgaagatttttactgaagttgtaagtcaacaactatttgttagtatatctgaagaaattttaatgagaggaattattttttacttattatcacagttgtttcgtaaaaaatattatgtggttattgtcagtgctataatttttgggtttgcactacatacgggaggagatttcttaagtaatttagtgtatagatttccagcaggcataatacttgctgtattaaggatatatacaaaaaaattatacccgcctatggtggtacactttatgtataatttgtggtgcatatatttgtaaagagaggtagaaaagatgaggaaaaatattattttatggattttagaaattgcattaggagtattagggagcatagcagtattttggggatattcatcaatgaacatttttacactatatggagtactgtttgtaccaggattactaacagcagccgtatatttatatttaattaaaagtaagaaagtaagtaaattacgtgggaatagtttatacatttcaagtatgatattttcgcttattgcaacgctggtatttggagtagttgatgtcgttttacgatctaagaatgatatgtatgaaactattatagcaaatacaagaaatgtattagatggagaatatttgattataaaaggaaatagtaatttaatggactatatctttatctttgtatttatttttctgatattctggtttataggaaaagggaataagatagatgaaaaacgaattgaatgttaaaaagttttgggaattgttaagaaaatacctgccacttaaaaaaaacataggtatattgctatttttaatatttagtcaagttttttgtacattatatatgcctatagcagtaatgaatactatagatattagtagtggaaattattatgagtggaaaaaaatttgttggattgcttttattattttgctacaagtaatattttcggtaggagtgttgtatttgatgtcttggatggctcataaaattattatgcaattgcgtgatgatttatggagtaaagttttgcatttaccaattgaatatttcgatagaacagaaacaggcgaaataatgagcaggataacaaacgatactatggtaattagtgagtttataacgaatgattttttgagtgcaattacaggtgctatatctataataggctctataattttaatttttgcagttgattggaaaatggcagcaattatggttggattagttccaataacagtttttgcaattagtcctttaaataaaaaattatataggatttcaagagattttcaaaataagacaggagaatatcaggcgagaatgaacaatgttttaactaatattcggttagtgaaaacatgtatagctgaagaaaaagaagaagaaagaggaaaattattaacgaaagagttatttaatataggtattaaaggtggaaagataactgctttagttcaacctttaacaacaatgttgatcttccttttactaattcttatatttggatatggaagtgtgagagtatcaaatgggagtttatcggcgggaagccttgttgcaattatatattatcttttccaaattgcaacaccttgtatgggattgacggcatttgtaggtcaattgaatagaagctgtggtgcgatggaaagaattagtaaaattttaaatgaagaaatcgtggagaaaaagattaaaaaagagattataatttccgatcaaaaatgcaattgtggattagtattagataatatttcttttcggtattcagatagaaagaatactctttgcagtatcagttttttcattgaaaaaggagagactttagcaattgttggagaaagcggatctggaaaatctactattttttcactgatagagagattttatgaacaagacaaagggaatatttattatgaaggaatagatgttaggaatatacctatgaatgattggagaggaaaaatagcatacgttcaacaggaatcaccaattatgtcaggaactattttagataatttaacttatgggcttgatagctataatgaaaaaaatgtattaagtgctttagaaaaggcagagttgaatagatttattagttcattgccaaaggggtataatacagacgttggtgaacaaggtgttaaactgtcgggaggacaaaaacaaagaattgctatagcacgtgcgatgattagaaacccagaaatattgctactagatgaggcaaccgcaaatttagatagttgtactgaaaaatctgttcaacgagcattagaacgattgatgttggggagaataactatagttgcagctcacagattttcgacaataaaatgtgcagataaaattgttgtattacaaaagggaagaatatgtggaagcggaacacatgaagaattatttaataataatgatatatatagaagactgttgttaaatcagataaatgatgagataaaaatataaattgaatttggatgcagtaattattttagaaaagaaggtgattccgatgttctaattgattatatagactaaaagtatgagggaggcgaaagctttgaaagaatattttaagattaaggaattgtttattgtaatagggatcgtaatgtgtattccatatattccattaacccaaaagatagagaaaaatttattattgttaggttttccatataaattttattctatccatataaatactcaacaaattatatctattcatttttcaataggcaattttcttttaaatattataattatatatacgttttatatattgtttttaaaatgctaccgcaaaatatacaggaggtataaaaatgaagaataagaatataaaaaaagtaattggtattattatgatattatgtacaatgtttttagtgactattccagtatatgcttcaaatgatgaaaatcagtttgagccaaacaaatatattgagcaagaacttaatacttgggcagaagcaaatggagttggggttgtttttgaaaatgtttatatctcacctagcaggagcgatatgagcgtggaagaaatagaaaaatcagtaaaatcatatgttaaaatgatgaagaatgctatgcagaatatggaggtgaaacttatagagcgctctaatatggcaagggcaacaggatcttatactgcaagcgtagaaagtatgattcctgcaatcggttgggggtatattaaacaagattttacagctaatgtaagttcttctcggatttcaagcgtttcactagtaggcagttcctatgatacaggttttacactcggcagttgggaacctaattattcttggacggatatatcaagcaataaacaatttgtacaaattcacatgaaaggtactattaattatttatgggaaggtttgaatatatcaaaagattgtacatttttagatacttttaaagccagtggtagtagcttggttgagtcttcttatttggattggccagattaaaatttatttaaaaatagtttatagtgatatgatatcttttttgccgtcagccttttgcaggctgacggtatttgaatgattcagtgcaggaattagcagagtgtatcaagcaactgctggatatttgtgagagggcagtaacaaggacactggatatagaaaatgattatcgtactatgcgggcggaactgcagagcaatatccgaaatccgctaagctgcataaaaacaagttgctttctaattcaattcacttacagaaaaggaaaatatccaatctgaaaagctccaggagtatcttcaaattatagaaagcagcggaggatatagagagtgcattaaaataactgataattgaagaagtgctggacggggatttttcgtccagtatttctttctggaatgagaaaagttgaatttacaaatcaagaggaggcatacacatgaagtatgtttttccagaatataaagagaatgtagtgttgggcaacgggaaattacagttaaatccaatgtcctatcaggttatctacgaaggaaaggagatagacctgacacccagggaatttgaagttttatatctactggctttaaagccaaactgggtaatgccaaagacaaatatttatcattctgtatggggtattcattatcatgatgatcagataccatacagaacagtagaatatgtgatatggaagataagaaaaaagatggggcatgatattatcgaaacgttggtcaatgtggggtatcggttgaaaaagttatagtttttgggagatataattgagatgaaatagtatgttattattaatggaggatttattacatgaacggaaataagaaaagtgcaaaacagtatcaccaatctgtaattactgctttagagaaaaaagtaaatgacatgaaagattccgcttattcaggattgtatagtgaaatagcatttatcattggaatagcagttatcatgatagataccttttttccaccagaggaaacgaaagttaattgtgtatggaaaataatactgatagctgtatctatagtctgtatgctttatttcgccaaaaaagtgaaaacagtgaatgaagtggaagaagagaaaaagttttggccgaacttttttattcaatgggcaacaagtttaggatatataaacatgcctgtagctgcgatagctattttggtaacctttgataagggcaaagcatggacattatttatgatgggagttgctgtaattctgacaggtttaactttaatagaagcacttgtaaaaacttctaaaattttaaaaaaagaaaatgttggtaagcggaaataagattgattaaaaaaattgaggtaaaaggtagacggtgtatttgatattatttacatctttttgttgaaatttgataatcatttttggtgatgaatattacatcattattattccaatctgctggaaaatacagataaaaggattatggatatttatcttgaattcggatttgaaagccaaaggacgtttaaccaggcgtttcagcagaagtatgggaggacacctagcaaatatcgaaaaatatggtgggataattgaatattatgagagttgcagagaatatatagggaaatattatttgcggtttgaaagaatttggagcggatatgcgatttagcgcatatccgcttttgacattgtagaaaagatttttgttttgaacggttacgttggtagacagtaatatttttatatggaagatgtgaaaaaataaaactattaatattctaacaaaaattacatagacagtcgattttattacatgaataaaatttcaagaaataaaaggtgtattatctaaaatgtaaggaacagaagaaaataattcaaccatttcaatttagaattagtatctgtactgtacaaaattgatttatgaaaggagaaataattatgagtgaaatgagaaatcctattacaagagaagaaaactttagcaatccggctggtaacgttatgatggagctgcaggaagcagatttaaacaaatttgtagcaggagctggtgaaaccagaaattccggcggagttttatgtacaagtacagcagaatgctattttggtactttgctgaaaccttgctgccctaagaaataaacacaggtgttgataaagagggtaagcgttaattgaagtttgtgcagtacagatacgaattgtgagttgaaatggaaagcagaatggggtgtttaagaacatgaatactgagagagcatcatattttacagaaagaagttatacaacatcagaagcagaaaataaaaaagatatatttgaatattggaaaaagattttaggagaagatacattaagagttgctgagaaatgttatggtattgatttagtaaaagttttaaattctgaaaattatgtatgtgaaaacaatcacgtgatgtcagaaatggaaaaggtaaaaatagaattatttgaaaaaccaatcaattataactattccggattcaaaggagaaaaattggcatttgataatttttttatacctttaatcaattacggaatagacatattaaaaaatggaacaagtcttttttggacggattctattatagatacatacgcaaataccttattagagagattagggaagatcagtcttggaatattaatgtttgaaatgtatctttgtaagaagacgggaaaactgaatggaagaaattcagaggaagaatacgattattataataataattttttaagtaagaaatcgtataaacaggagcttttcaatatatatccatgtttactacgttcagttacagaaaccgtagaaaacttatcttcttattatgtacttttattagaaagacttaataaagataaaaatgaaattgcgaataaattttgtggaggtttagaatttaaaaatgtagttgaaataagttctaatatctcggattctcataaaaaagggaatggggtaagtattcttaagttggataatggcactaaaattgtgtataaaccacgttcgttaaaaattgaaaaagtgtatttcgattttctgggaaagataaatgctggttgtaaatatgagatgtatgaaccaaaaatattagattgtcaggagtatggttgggaggaatttgtatattataaaagttgtaaaacagaggatgaaatcagacggtatttttatagatttggaatattgattttcggtagttatattcttaatacaaatgatttacatgaagaaaatgtgattgccgcaggagaatatccaattattatagatgcagaaactatactagataaccgtagaagagggagaacaaattctgcaaaggaggaaataaattatatccttcatgagtcagtattatactcaggtttattgccacactataggttttcaaatttgggccaaggcgtagatatgagtgcaattaaaggtagtgagggaaaggaatatcctatagttattcctaaaatagcggatttatgtacttcaaatatgagatttgtatatgaacatcctacaactggagtaaatcaaaatcttgttaaattagaaggagaaaatgtatcagcatttcattatctaaaagaaataaatgcaggatttgaagatgcgtataaatatgttttggagaataaagaaaagtttcttgaatatgccgacatgtttggtaatttaaatattcgccatttagttcaggatacccaaagatattctatgttattacacacatcttttcatccggattttatgcaagatggaagagatagacaaatgtttttgtgtagtttatttaaacagtatgaagctacacaaggagataaaggtgttgtgaaatgtgagataaaagacatgttaaacatggacattccatatttttatctcaatacatcaggtaaatctcttttcggatcagaaggtgagaaaatcgaagactattttgaatataccagtttggaacacttaaagaaaaagatagtattgttagatgaagatgatttaaaaaggcaattaatgttcatgaatattattctgacagagataaacgaatttcaggttgaggataaaaagatagagcttcaacaaatgaaaatgattccgcacagagaaaaaaataaggctcatctgttaaaagctgttcagaaattggctgattctcttataaaaactgctgtttttaataaagatagaacagaagttaattggattggtgttactctaataggaaatgaagatgactgctcatgggatataagaccacttggtacctatttatatgaaggaatgtctgggctagcaattttctttaacgcattgtatgctgttgatccccaaaaggagtaccttattatacgcaatgcgattgaaaaggaattatttacatacacagatgagatgtgtgaacgaaatgagggaatagaaaatgaaagcagtggcgcctttggtggagaagcgtctataatgtacacttatgaggtactgtataaaattacaaataaagaaaaatatttggattatgcaaaaaagcactataaaatattaaagaaagcgattaccagagataacagttttgatcttgtctatggtaatgcaggcgcagttattacattgatcaatatgtatcagctaactggaaataaagagtatatcgcttcggcagaaatagcaggagatataatagtaaatgctcaggaaaaggaaggctctattaaaggcggatggaatggagatggaagaacttcgccgttagcgggattttcacatggagcatctggaatagttttagcactggcaaaactatggcaggtgactcagaaagaggagtatttattatcactgctcgatggcattaaatttgaaaattctttatttgtgaaagaaaaaggaaattggaaagacgaaagggtatatgcaggagaaaaagcatctgatggaggaagttttaccgttgcttggtgtcatggcgctgcaggcatattgcttagccgatctaaagtaaatgtcatattgaatgggcggtattcggatttgatagaaaatgatataaaagtagcagtgaatacaatattaaaagagggaattttaggaaacaattgtctatgtcatggtaatttaggtaatacagaaattttatttgaatatttaaaagaccattcagataaaaagatagaaaaatattatgtagatattcgtgatattattgctgagaatgtatgtaatggtgtatttgattgcgataatgcgtatctatatggatataaattgcaaggatttatgacaggactatgtggcatgggatattctttgctgcgagatataaaaaaagatttaccttgtgtaattgctctggaagtctaaaatgatagtattggaaataatagaatttattatttccaatactaatttattatactagggaggtgtatttatgcacaaaaaaagtgtgccattgattcgccagatggggacaacagactgtggtatagcagcattgacaatgatcttccaatattataaatataagatagatattagtgaattaaaagctacaacaagtattggaagaaatggtatgtctttagcaaaaatgaaagaaattacggaagaacataatttttcattcaaggcgtatggaaactacgaaaccgaagaaaatttgataaaatgtttaccgattatcatgtgttcaaaagaaaatcattatgttgtagttgcggagaaaaaatatgggaaatatatacttttagatcctttaaaaggaaaagaaaaggttgattattcatatattaaaaagaattttttagatgtacttgtatgtgttcgaccaacagaaaagaattataaacgtgagaaacgtgagtcttttcttatacctataaataaaagcaaattatttctggcaagtattctaacgttggttacacagggaattatattgattccaccgctcattataaaaaaaatagtcaatgaaataacgtatgatacattaggcttcaattttgtaaaatatgcgttactgatattatcagtggcattaagttatttacttgcaaatttagctaaaaaaagggtaatacttattttacagaataatatatacaaagatactatatttttaatgctgaataaaatatttgatattgatttaagttattttgaaagccattcatcaggagatattgaaaatcgctttaatagtgtcagtgatatatacgaatttatatcaacagctctaatttcaacagtgatagatgtggttactgctgttttttgcggaataatgatgataacacagtcaataccattgtttgcagttataatagtaatgactgttatacagataacaatagtaatgattttaaatcaaaaagctagaataaaggttaaaaattatattgcagatcagagtgcattacaggcacgaatggtagaaactttgactaatatccagcaaataaggtgcatgagaatagagaatatgctgagtgatagtctgaaacaggattataagcatttaattaagagattacgtgagcgtgtacaaataagtgatattatggagtcggtggtgggggctttttcaatagcttcttcattgatactttacgttataggaggatacttggtttgtgataataggttggaattaggaacgttaatagcctttgtcacacttgccggatattttacaggtccatttcaaactctatctttggtggtacctcaaattaatgttttaaaggaaacaatgattcgtttaaaagagttaatgaattataaatctaaccgtaaaaatggtactcagcatattaattcatttgagtctatggaaatgcagcaagtaacattttcttactatggaagcacgaagccagatgtagagaatgttagtatgatgctaaaaaagggggagaagatagcatttgtaggaagttcaggaagtggaaagactacaattacaaaattattattgaacgtcttttctcattatcaaggacaaattttagtaaacggggaagatataaaacaaatatgcaaagaggatatagatcggatatttgccatagttactcaggttccaatggcaatgaatggaacaattagagaaaacgtggatattacaaatacgttgacagatgaggaaatatatcattatttagatttagtagaactgaaagatgatatagaaaaattcccattgggacttaatacatttgtgggagaaaatggacagaacatttcaggaggacaaaaacagcgtattgctatagcaagagcattggcactgaaaccggaagttattatttttgatgaagccacaagcaacttagatcctcttacagaacgaagaatatgtaataatttgaaacaactacatattacccagattgtagttacacatagactgaatgccatacaagatgctgatacaatatacgtagttgaaaaaggaaaaataattgaatccggaacacatgtggaactacttcagttaaagggcgcatattatgatagtgtaaataattaagaacaggtgaaagtcagataatggctttcacctgttcttttaagagatcttttcttcatacggatcaatatgttcaataggtatctctaatatgacctttaagccatgaggaagtatattttcatatttgatatttccgttatgggcggttaatatttggtaaaccaattttagaccaaatccatgaacagactccccatttgaattgtacatattattaggaaaaataccactattcattttttctatttgtgtagaagtcataccgccaccattatcaatgacggaaataatacaggtatcattttcttttaaaatttcaactgttatttcacaaccatgaggattatgattaatacaattttgaattagattgcttagcattcttgaaaaaagttccgtatctcctttgatcaatactggaatcgtatcagatgatgaatgaaaatcaaaagaatatttgttgtctattggtccattcataaagccaatgattacttggcgggcaatttccacaggagaaaaactggtttttattaaaggctgcatagagtattctagtcttgaagttaaatttaaatctgcgattaggctacggagtttttcgctttgtttacgaattatacttgcttgtagttgtacaggttgcgaagcatcttcatttttttcgatttcagaagcatatcccaaaataatagaaagaggtgtccggacatcatgcgaaacaccattaatccattcggcacgcgcctgttctttttgtagaagatgttttccagccttatttagttcagcatttatacttgaaagttcacctgtttctgaaagggtaatgggttttccctgagcaatagagtcaataccgtcaatgattggcactatagatttttctattttatgtgtattacgccagaataatataaatatcagtaatatattaaaacaaatcattaaaaagataccgactattaggctgtgaatataattaatatctattgaaaaattgtattttgttatactattaggttcgcacccgataaccaataagccggcagaatgttcttggataaaaacaggatattcttgtaagtaccaccgactaaacttggctatttgtaaatttgaataggttcttggcaattcttcgggtaaaaatttttcccaaatgacatttccttgttcgtttaaaatcatcgcccaggcacttttattttttagaatattttctatataatcagtagaagaaattgttccatctacattgagcgtgatatttttgctaatggtttggacgggtatatctggatcagtagaattattccatgccatgagtaaagtcccacatattaaaataatatttagtacaaaaaataaaatcaatataataagggtggaaagaagatattttttaaaaaaacgcttggcaagcttcattattttactcctttcactagcaatttatatcctagccccttaactgttagcagtgaaacaggagaagaaggatttttttcgattttttctcgaagatgccgaatgtgtgtcatgagggtagtttcatacccttgccacatttcaccacaagcagtttggcaaagagttcctattgttacaatgtgattggcattatctacaagttttaataatatattgtattctttagcagtcaaaggaataattttattttcacgatgtatttctgccttatcaatatctataaaagaattttctaattctataattcgtttctctgtaggataacttctttttaaaatagcttgaacacgtaacaatagttctttaggcaaaaatggtttgattaaataatcatctgctcccaattcaaaaccagaaaaacgatcttcggctgcatctttggcggtcagcataagaaccggaagtttactgagggctctgatttcttgcaatacctcaaatccgtccataccaggtaacataacatcaagaataaccatgtcaggtagagtttctcttattatttgtaaagccatttctccagatgttgcggtcattatttttgtatagcctgctctttcaaatattgttttaataagggtgagtagttcttgttcatcatcaacgataagtataaatttatcatacatatatttttatctcctaaaattttatagtttaaattattatacatcttgtggaaaaagaagtatagagaaagaggaaaatctcaaggttacctcaaggttacttcaaggaaatctcaatgtagttggtatataattacagtataaaaaaaggaggtataaaaaaatgagtgaatatattattcaaaccaataatttaacaaaacagtatggagagcaaaagagtgtttctgcaatgaacttgcatgtgaaaaaaggaagaatttatggactgttgggacgtaatggagcaggaaaaacgactacaatgaaaatgctgttaggattaacaaaaccgacatcgggaaacataaaaatatttgggaaaagtatggaaaccaatagtaaagatattttaccgcatataggtagtttaatagaatcaccaggattttatcctaatttgactgggactgaaaatcttcgtatttttgcggagcttagaggattaaataaaagtaagtgtgtaagagatgctttggaagttgtcggtttgccctatcgtgataaaaagttatttgcggaatattcacttgggatgaaacaacgactggccattgcattggcagttatgcacaatcccaatttgctgatattagatgagcctattaatggtttggatcctataggtattgcagaggtacgttcgtttattagagagttatgtgatgttcagggaaaaactattttgatttctagtcacatattatcagagatagaattactggcagatgatatagggattattgataagggaattttacttgaagaagaaagtatgaaagaattggcgaaaaaaaatagtcgctatgtcaattttatggtatcggatagccagcgcgcagcggaaattttaagaaaagaatttgaatgtgatgattttcaaatatgtgataaaaatagacttcaattatataatacaacaatccctagatcagaaattacttatgtttttgtaaagcaaggattggaaattacagaagttcatttatgcgaagaaacattggaagattattttaaaagggtgaccggaggtgaaggaattgcttaaattagttaaggttgaatttcaaaaactgaaaagaaaaaagtttattcttttagtaactttagctgcatttatgtttccgcttccattggcttatttaatgacaacaccagctatgatggagcaatatattgataaagcggacgcatttgacggactatttaatatggtattggggtatggaatccaatttttattaccctgtattatcggagtagtagctgctatgttgttttttattgaacgtgataatgatacatttaaaaatattaaaacaatcccactatccagtacgcaagtagttacagcaaaaattatagtgctatttattataggcgttgtattttgcatagcatcaacggtagcaacagttctggttggtatgtttacgttagatgtatacggtttaggatacaaaatatttctggcggttgaaacaggaatatttattaccgcaggaacattaccattgattgttatagtggtattttttagtcgtacttatgttttctctgttttattatgtattttttatagcgttttaaatatgagtgcaacagcacttttcgatgcattaccaaagacaatattatggttacttcctacgccgcttacaacattttggagtgctggagatatgaaaagacatggaattaatatgaaccttgtacaaatgaatggattaattccttcaacttttcaagtaatattaattcttgggattatggcaggaatttcaatactattaattgactgtttgtacaagaaaaggggggaataaaattgaggactattgtaaaaacagaattattgaaattaaaacgttatcatattatatgggcggggatagctcttatgctactctctgttctattgacactttttacttctatggctaatgatggatctgtatgggattttcgatacttaatagagcaggtaatcaaaaataatatgtcaatgattttcccaatgtgcatagctttgattgctggatatattatatcgcgggaagaaaaagacgatgttttgaagaatattattaccattccaatttcatttaaaaagttgttggtaggaaaacttattgtatgtgcaatgttatcaatattatttgggcttatttgtacgatatttacgttaattgcagagtgtatagttggttttcctggatttacagtaaatttggtaatccaagggctagtacaaataacattggaaaatttacttttgtatctagcggtattaccaattattgttataacaagcagactatcaggcggctttatgataggtgtcattgttgcttttgtgtatggatatggaggtatgtttgcagcaggaaatatgacattggctaatatatatcctattactgcaagtctgggattaattgggtatagaagttatgatacatccgtacaatggagttttccattgtgtttatgtagcttgataattattgtcgctatttctgtaattttagtcgcaacaatgaaagaaaaggagaacaaaaaaactcgtacaaaaacaaaaaaagtcaaaccaaagaaagggtggttataagtgaaaaaaagttgtttctttattctaatgttttgcttgttattgtctgggtgttcaaaagaggaggtgttggaaaaatataatgcagtagtcgaaaaggtgggagaagtacaattaaccaatgatataaacctgcaagggaaaagagattatggggaagattattatacggggacatatcaagcagagtacaaaaaattttctgatacagaatatctttttggaggaacaacaatagaaagagcggcagggaagcaggttgaattgttttgtaacctagaaataacaaaaggagaagctgaaatattcattatttctggtagcaatgaacctaaaactttaatagaaacaacaggtacttatgaaaatacaataacattaccagatggcagtaattatatcgggattgtaggtaatgatttttcaggaacagtaaaaatagaagtgaaataaagatagaaaatgctaaaaatgggtaaatttggaagatacaggtttggttgcattttactgtggtaaaaagtatatgaagagtggaatggcggttgtttaatactgccattctttttttgaaaatgcctctatgggaattattacacagggaatcgaaaaaattacatgtagatgggatagtacattaaatatggtaaaatataatcataatatgagatcggaggtatattctatgaagaaactatttaaagtattcagcctaatgctggtggtgataatggcttttccattctctgttatggcaagcgaaaatgaccagcaaagaagtgatttgattggtgcagaagaaagggattttgaaaaattgattgcagaaatccagaacattaaggctactcacccagattattcagaagaaatgctcatgtcttttttggaagccaatcatcaagatgtggaaagggggattatagatatttggaatgcgcttacagattcagaaaagaaactatgtattcgttatccttttgatgccctaaaggtaaataaagcaaaaaatattgctacttcgcagacagaggcaaaatttgggacaaatggtttaggaaatagaagtgatgcttttcgtcatggaatttggaatgctgaaatgactgttttaataggaaaagaaagagcagagttatttgcaactgctcatgaagacaaagatgttacaggaacagaatcagacggatatccaaaaacagcacatagagatatggacttacataacaatgaagtgggaagagaaataggagaaaaaaataaagaagcttctgaaagtgaaatggcggatattatttatcaggaaatatattccgcaacaacatcatttatatggctacatgaataagatttgagcagtgcgattgcactgctcgtcttcgtattttgcatattttgcgtaattgattacttctattatttgtatcgctatgaatgaaatagggtagcatgatagtacaacatgattaagaggtaggcaattatggaaagtcgtattaaacaattacgtgagaaaagagggttaatacaggaaatccttgcagtagaattagggataacacagcaaatgttgagtaagtacgaaagagatgttacgttaataaaagtagatattctgaaaaagattgctgcttacttcaatgtaacaacagattatttgctgggagtttcagatgtaaaaagagatttgaatgggcagatgaaaatgaacgaagtactagacgaatattacgatttagtggaagtgtataaagagttagatccatgtgatcaggagatgatttggtcaattatacaaatagtaaaaaaaacgagtgagaagaaaaaatcagcaaacatgcagaagagagtggagtgaatgttaaatatagcaatttgtgatgatgatattcaaataactggaaaaatcgaaagacttctccaggatatagctaaaagaaattttgttgatactgaaatagaagtattctggaatggaaagagtttagcagatgctatcgcagcaggtgagaggtatgatgttatttatctggatatagaaatggataaagaagatggtatttcggcagctagaagaattagaacatacgataaaaatgtgcgaattatttatgttacgagccatgaaagttatatgagggaatcctttgaggtaagaccgtttcagtttcttgtaaaacctgtaacagataaaataatggaaaagtgctttaagtcggtatatgaagacattaatagtgaagatttttattttcgctatagttatcaacgtatgaatcataaagtaccaatcaaggatattttatattttgaaagcaacaaacgaaaaatatttattgtaacggaacaagaaatccttgaactgtacggaaaacttaatgagattgaagaaacccttaaaacatgtaaaatttcttttttgcgagttcatcagtcttttctggtgaattataaacatatatccggacaatcttatgattctgtagtaatggataatggacaaaaaatttcaatcagtgaagaccggagaaagataattagtgaacaatattgttctatggaggatacgttttatgtggacgaatagggtattaatgtgtgggatagatatattgctttgcctttgggcagtatatttattctttttttatttcgatatattttttgctcgtaagagaaaaaggtatttgtcggtgatcggtataacgctgttcgtgatttggcaatttggaataacaacgattattagttttcctgcctacatcaatattgctgtgacgattatgtttacgtttttggcagttatgatgacttatgaaggtagatggtggaacaaaggtgtatttgtaattacctttaatgcgatttggatgttgatggaaaccctgtgcaactatattttgctaacatactgccctcaatatgctgcagttcgccaagtaggctctttcgtttcaaaaatattttttaatgcagtaattcttgcattaaagaaagtgttcacagatgatgatattaaggaattgccggtcagatacagtattttacttgtgttgatcccaacaggaagcatttatatcatgaacaatatatttatgcttggatttgcaaataataatggacgtactcgtataaactctacatttactgtacttattttacttggtatgaacatattgatattttatgtctatatgaagttggctgatgatttgcggttaaggagaatggcagcagtatatgaacagcaactggaattatgcgaacgtcatcagcaagaaagagaactttcaatgttgcagttgcgggatataaaacacaatatgaagaataatcttatttccattcttgcttatgcagaaaataaagaatatgaaaaaatgacaggttttattgaagaaattatgggagagggcggtatggtgattgcctcaatatcgaatagtgggaatattgtgattgattcacttattggatattggtatgtaactgcccaaaacaaaagaataatttttaaaacggatatttgtattccgatgataatgccttttaaaggagctgatctgagtctgatattgggaaatttactggaaaatgcagtggaagcagcagagaaggttgaagaaaatagatatataaatgtcaaaatgaaatttgataaaaataatctattattgttcgtagacaatagttataaagggaagctgttaaaaacaagagataaccgcttgaaatctacaaagtcagatgcagaaaatcatggagtaggtttagcctctgtgtatcgggcagtagcaaaatatcatggatcagtggtaatagaggattcagaaccaggaaaatttaaaattcggatagtcttatatagtaatgtgcaggaataattacatgaacactcgaaataattacataaaaaataatgagaaaggaaagaatggtaaaatggaaagataaatttggtatgcggtatggggactgatatatggatagcgtgaaaatattgctgtttagtgatgatgagaaactgtataacagtactgaaaggattattgggaaaaaacaccaattaaaatggtgtacttatcaacagttggaaaacaatagatatccaacggcagatgttgtgattttccattttactaaagagataatagagagggaaagggcatttgcggctattataaaaataaaagggagtttggggcatttaacgcctattcttgctattagcgaagggggatcaatacaggatattttttctatactgaaagcaggagcttacgattatatagaaacaatagataacacacgaaaatataagaaaaagatagagaacctgattttatggaattggtatataaaaaaacatacatcagcaaaaaagaggcaatgttgagaaagaaccggagaaacattgcttcttttttgctgcctttttgggaaaaattacatcaatactcggtttttttacaagagaaccgaatgggagattttttgtagtaatgtattggtaaacaaatgaaaggagattttaattatgaaatctaaaaatttaaaaaatcagccagcaaaagtattagcaaatttatctctgaaacttggtaaaatgtcagcggacagtgcttgctgttatatttatcatcagccaaagatgccagaagcattgaaaaaaatgaagaaactttaatttcatgggaagattatcggaaaaaataacaagatacgttattgatgccggtgcagtttcagaggaattgtatgcagtatatcaatatggatttcagattggattagagatgttaatttgcctattcgtctgtatgagtatagcgatatacttgcatacaatcccagaattccttgtgtctacaggtgtttttatgtttttaagaacctatgctggtggtgtacatctgaatagctttaaggcttgttttatatgctctgttactgttcaagttatgattttgcaaattaataacaaatatccattagagctgtttgtggcttgggggattattttggtcagttccatttgtatatggaaactttctcctgtagaaaacattaaccatgagttgaaaaaagaagaaaaggaacattgccgaaaagtaacaggtaaaatactaggagctattttcattgctgctggctgttgtacagctttaggtatgaaaaaatatttatccttgattgcgttgacagcgttgaccgtttttatatcacaatgtatcggcatcataaagtataaagttgaaaaagagaaaaattagcgggaatgataaaatattattgtttccgcgttttttatttaaaatggtaaaactgtacagaaatatagaaaagactgttgtgggaggaaaagatgcagaatattttttcggaatacaaagataccataattgttgttgacctcatgaatcatcaaacaactgatttacttgcctgtctctgaattaacctgtatactgccatcagcatacaaaaggaaagcgtgtgaagaaacagttagtcatccgtcaacgcatcgatatgcactgtacaggatgtaagcaagagatatttacaaccaaggcattggatgagatccataaggcatctgcaggaatcccacggatgatcaaccgtgtctgtgaaaaagctttgatgtatgcgtttcaaaatcagaaacgattgatcgatgattatatgatcaagttcgttgtggaacacgagatgcttaggatggtaacttcataaagcaggtaccgcctggaaacaggcggtattgcctaactgactggtgacagaaagttaaccaaacgagcgtcaactgatgtgagcaatcttgtgacatctcatgaaatcactaacacataatattgagaaaagaaagggaaaactttagcttgcttttataccttttagcttaaaaatcaattttagaaggatgccgcggctgacagtcagcataaaattgctttgaaagataatggacatgggataacaagatagagaaaaaattatagaggaaattaagatagatgttgacttgtacaaaaaacatctggtaagtaatagagctttatataacgatatcaagaattcttaataggattataattaaatagcacgaaaaggcagaagtgtttgtatatataaaagttcttatgaaaatcttaatagtttttaatgaaaatcataatgaataaataaaggaaatttgttataattcaaattatggaaagagggtgatgatggtatgtgcgaaaaaatattagttatagatgatgagaaggatatagcaaatttactggaagtttatttgcaaaatgaaaattacattgtttataaatattactgtgctaaagatgcaataccttgtattgaaaagggcgatatagatcttgctattcttgatattatgctcccggatataaatggtttttccttatgtcagcgtattcgtgaaaaatatacttaccccattattatgctaactgccaaaattgaggaaacagataaaattactggacttacattaggtgccgatgattatgtgacaaagccatttcgtcctttggaagtggttgccagagtaaaagcccagctacgacgctacaaaaaatattcatccgttacaagtgaagaaggaataaagccagaactttcatacaataaattacgattgaacgtgcagacacatgaatgtctattggatggtgagaatgtgtcgctgactccgaccgagttttcaattcttaatgttttgttggaaaatgccgggacggttgtaagcattgaatatttatttcatgcagtatggaaagaggaatattattcaaaaaatagcagcactatcacagtgcatatccgacatttgcgtgaaaaattaaaagatacttctgataccccgaaatatatcaaaacaatttggggagtaggttataaaatctgaaaggagaacccatgaaaagaaagcgaaaatttggggtgtcagttctttttttgatttatctggcacttttggtttggataatattatttaagctgcaattcaatatcaatgatttagacactgtaagaaagataaatattattccattttattacgataaagagattggagtagattttcacataaaagaagttcttgaaaatttattgatttttgtcccaatgggcatatatctgcaaatgcttttgtttaagagcaaatcctatttgaaattattgataattgctggaataagtctattgctggaaattacacagtatatacttgctattggtagttctgatattaccgacctgattactaacacagcaggcggtcttttgggtattgctttatattctattgtggctcgattgctaaaaagtcgagaaaaagcagataaattatttttggttattgctgtaattgtgagcaccttcataatcggtctgttggcacttcttttatttttaaattgattggaggcgtgcttatgaaaaaaaagcaacttactacggaaaagcggcttggagtacaattatatttagtactatttttatatactgtaactggtataggactggaaattttggcacaattcatttttccgaaattcgatagcaaaattttatcatggctatactggcgtatagatatgatttttattttctatctaatcattggttttgtatgtatatttaattacttctggaaaaaaccatggggatatttggatgaagttatttccgcaacacagacagtttatgagcagaatgatcatcctgtagcattgtctgatccccttaaagaattagaggaacaacttaaccagattaaactgtctgtgttgttaagcaaacaggtagcaaaagaagctgaggataggaaaaatgaaattgttatgtatctggcccacgatatacgcactcccctaacaacagtgattggatatttaagtttactccacgaagcaccggatatgcctgaaaaacagaaagaaaaatatgttcaaattgcattaagtaaggctgaacgacttgaaaagcttatcaatgaattgtttgaaattacaaaatataatgcacacactgtctcgttaaagaaagaaaaggtagacttacagtgtttgttggcacaggtagttgatgaaatatatccctctttatctgcaaaaggcaattcggctgcttttacggttgatgatgatttagttgtatatgctgatccggaaaagctggcaagggtttttagtaatcttttgaaaaatgcagcggcatacagctatcctaatacagagattattataactgcaaagcgttgtggtaatagcgttcaaataaactttgaaaatcatggacggactattgaacctgaacaaatttctggcatatttgaaaaattcaatcgcttggatgaagcccgcctttctgatacaggcggtgcaggattaggactgtcgattgcagaggaaattatacgattacatggtggaaccattactgcgtttagcgaaaatgagatggtgtcttttgtgattatgcttcccatttctgattaggcatttagaagtaaaatcttaggaatttcttaggagattttgttccatatctttgagattaaactgtttttgttcggtacaatagttactgaacaaggacagttttttgtttaagagaaaggagtacacctatggaattaaagattgaacacatcagcaaacagttcaaagataaaactgcagtcgatgatgtcagccttacattaacaactggcgtatggggattattgggggcaaatggggctggaaaaaccactctcatgcgaatacttgcagacattatgacacctagtagtggtcgtatatctttggatgggaaagacattcataaaatgggagcagattatcgcaatatctttggctttttgccacaagattttggctattcccgcgattttacggtcaaagactatctggaatatgttgctgcactaaaggatgtgccgctcagagaaaccacaaagaaaatcaactatctgttggatattcttaccctttctgatgtgaagcgaaaaaaaattgcacaactatctggtggtatgaaacgtcgtgtaggaattgcacaggccatgctgaatgaccctaaaattcttgttatggatgagccaacagcaggacttgaccctggagaaagagtacggtttagaaacttcatttcggaattttcccatgaccgtattgtgttgatttctacgcatattgtttctgatattgaatatattgcaactcgtaatgcgattatgaaagctggaaagattattgatgtgggaacaacaagcgatttggtaaaacagattgaggggaaagtatggagctgtgcgattcctgctcataagatgatggactatgaaatgcgtctgaggattatcaatcagcgaggcgaggacaataatcaaatatctattcgttatcttgcagagcactccgaagtagagggttccattcttgcggagccgcgtttggaagatttgtatttatggttgtttccacaagaagatgtcgaaagggaggaaaaataatatgcgtttattttgtttagaagtaaagcgtgtcctgaaatcacgacgcacacttatcttaattgctgtggctctggttatgtctgttgttatggcatatctgccgattgcttttgagtccataaatcgtccaaacccagatggaacaaaaacagaacttgatggtatggaggcaatcgaatttaagcgtgatttatattctgctataaatggcgaagttactccagaaaaagtgagtgaggctttgagaatttatcaaagtttgataaacgaatatggtcctatggaaagtgacacatttccgctttctgtcagtattaaacagattgtacctattcgtccattgcttaaagcgttgccagaactatatgctgatccgttaactggaataggacctgatcttatggatattgatccagaagatgttgcacaaaattattatcagaaatgtgaaactcatctggcagatgttatgaggaatgagcaacgcaatcatccggccgcacaacaacaagccttagaacaatataaaaaagtcgatatgccatttcaactttatgcaggatattccaaagacgcgtttgactatgttgagctttatattatgattttggcaattttatgtgtttccattatcacgcctattttttctggtgaatatcaatcaggcgcggatagtattttgcgttgtgcaaagcatggtcgtaccagattagctattacaaagatattggcttccagtatgattgtgatggttgtgtatactatgtgtattacactgcacttagcaatttcagatatcacatttggaacaaattgtttacaatcttctgttcaaatgttgttttctattattaacttgccaaactgggacttagcacagatgcagattgttatttcgttagtagggttgatatctgttttagcttgtgtttactgtactttttttttatcagcaaaatgcaaagatacattgacggtattgttgattgctattggcatagtccttattccgacttttgcttacacagcattaggggtaaattggatttcagctatttttccatctgcgggacttggtatgcaaaataattttctgtatcaacttatcaattttaattacctacatattgggggaatgagtttttggacaccgtatactatattaatttccgcattgattgagattcctgttttcttatttcttacagttcgaacttattgtaggcaccagatgtaaatataaggaaaaagggctatattcataaagtatagaggatttattacatcaagtatcgaaattgttacatcaaaatatattttgggggatttattgatataatcggttcataataaaaaatccaaatgaaaggagtgtttagagtgaaagagcagaaaaaaatatctttagaatcgctggtatctgaaatcgaaaaaaatggaagaattgggcgcttgggtaaagtttttaagacagaaaaaaattattatttttatgatacaggaactggaaaagttgccaaattaaattcgaacgtttacattgtactgaaaagtttattggagggaatgccagtcgaagatattaaaaatcttcaattaagtaaaagtgagtttgaggatgcaatttcagaaattaagtcggcaatggaaaatgaacatattttacaagctccaccattaaaaacgctgacaggtgatgcagtaacagagttagatgatattcttgaaaataaggttgagaatgttactcttgaagttactgaaaaatgtaatttacgttgcaaatattgtatttatcatccttctcatccagaatacagggcgttcggacatgaaaacatgaaatgggatgttgcaaaaaaagctattgattttttaaaagagcattcccaaaatgcagaaaataggcacattggattttatggtggagaacctttactaaattttgaacttattgaaagagcagttgaatatgctaaaaaattatttggcgaggatatgtcctttgcaatcactacaaatgcaacattggtaaatgataagatcgcagagtattttgccaaaaataatttcaatattattattagcttggatggtcctcaggaaatgcacgatgcaaatcggcttatggttaatgggacaggtagctttgaaaaaacagttatgggagcaaaaaaactatttgaagcattccataaggaaggaaagagttctaagattggatttaatatggttgtatcgggaccaggttatcttgaacagtatacaaaaattcaggagtttatcgaaaaaagtgaatggattcccaaagacgttatgattttgactgcaacggtagatcatggaccgtcagagagtgattactttttaccgcaaggaaaagaagatagatggtttatggaagagttttatgaacctttaatgaaatgggaagaagtgtataaatcaaatccagataatacagaaaaaactttgtttacggatggttatatggataagggaatgatgattatacacaaacgcttgttgacagaaacacctattcaacagtatggaatgaatggatgctgcgtgccgggacaaagaaggatttatgtcactacaaaaggtgaatttttacattgtgaaaaagtaggaaatataccttgtttaggcaatgtgaatgagggatttgataaagaaaaaattaagaaactttatgttgaagactttatagaagaagcaaaagagtattgtaaagaatgttgggcagttaatttatgtacattatgttatgttaattgctacgatgctaatggattacatctttcatatcgacataattcatgtcgaaacgaaagaaagtatttggaagacaatttaagacgatatcatgcattaatggaggcaaatccaagcgaattggaacaatataatgaaatggaaattcattaacaaaggtaaatacgtttatatttacatagatgtatttaaattacaaagaaaggaggaatcgttatgaagtttgtaaatccaattggaagaacacctggatcaggagtgcagccgagagcatgcatgtgtactgatggatatgcaggttacagaggcaatgatgatggttgtgttcattgtggctgtggctgtggtggcgaaggagagtatcgtacaggtaacagagtaaatgctgttgctacattccgttctagtactctctaagaggtagtaaaaacgaaggcgtagtactatatgtgctacgccttcactatataggagaaaaatcatgctaaaaaaaataaaaaggaatatttttttgatttattatacgataagattaatttgtaaaatatgtaaagcaaaatttattctggcatttattttgtctataataaatggaattcttcctgtttcgtccttattggtaatgcaacagttgttaaatgaaatacaaaacaagacacaatcatatcaatatgtggtgtatcttttgattttatatttcgggctaattatctcggaatcgcttttacagaatttagcaagctataatttaaacaatttaaacaatcatttagtttatggaataaattacattcttatgaaaaaatgtggggatttatcattggaaatgttagagagaacagaaacatatgatatgataaatcgtttagaacaagaaattggaaataaaccatatcagaccatgcaaggggtattaggcttagcatctaatttagtttcgttattttcagccgcaatgatactactttcatggaatccaattcttgtgattataatgattgctgtgtcaatattaatgtttataggacaaatttatgttggtaataaagaatttctaatgagatatgagcgcagtggaaaagaaagaaaagcgtggtattatacatatttacttacacatgatacagcatttaaagaggtaaaagcatatggattaaaaaaatatttgctggataaatattgtagcttagtcaaaactttcataaaacaagccaatgaaattgaaaaaaccagagctgttttaaatatgattatttcgtttatacaagatatagtttgtataattataatgattattgcaatatatttggcttacgtagggaaaaaaatgataggaaccactatgtcatatttaaatgctgtgtccatgatgcaaaatgctacaaatagcattgcctctaatgtttattctatttataacgcaaatttatatatacaattactaaaagattttttagaaataaaagaaggggagaatgcgttaggtggtacaaaagtagataatataaagacaattgaactaagaaacgtatctttcgattatcctcaatgtaaaatggcactatctaccattaatttaaaaattaaatcaaacgaacagattgcaattgtaggaaaaaatggatctgggaaaagcactttatttaaaattttatgtgggttatataaacctactagtgggaagctatttgttaataatcttgatttggagaatattgatgtaaagagttacaggaattgtatatctgttctttttcaagattttttaaagtatgaaggtacattggaagagaacgtttatataggagatattagtacagaagtcgatgaaaataaaattaaaaattcattgtgcaaagcaaacgttgattttttaaaaaccgaaagaggatacgaactaaaaagaggattaggaaattggtttgatgaaggaggtcaattatcaggtggtcaatggcagaaaatagcgttagcaagaacctattataaaaatgcagatgtatatttgttggatgagcctagttccgcattagatgtaacagcagaaaccaaaatttttaagagtttttttgaggtgagtaaaaataagatagcaatatatataacccatagagtaaaaattgcacaggatgctaataaaataattgtattagatgggggtaaaatagtaggtataggaacacatgcagagttattgaaaaattgtagtgtatatcaagatttatataatcaagagaacctaaaaaataaagggtaatgcatgatgcctactctccttttggaaatagagagaaatgctgctgttctaacatttcccaacaattatttataggatgaatattcggtggatatgcacaactttaaaattaggcgcttgcataaaacggaacatatctaatctgaaaagtaagaagcatattcatattattgtgaacttctgtgaaaattaacgctcgattgaaacaactgagtgttttcaatgtttccatcggatttaaagtaaaattctgagagttaattaactctacgaggaatttataaaattcactgtaaacggctgaaataaactatttttagaaaatgagagttaatttttcaggaagttcacaattatagaaaagatggcagagatagaaattatgtaaaaagtaaaaataactaaaaaagtgccggatgttggatatttcgttcggtatttctttctggaatgggaacagttagaaatttataaatcaagaggaggcatacagatgaagtatgtttttccagaatataaagagaatgtagttttgggcgatggaaaactgcagttaaatccaatgtcctatcaggttatttacgaaggaaaggaaatagatttaacgcccagggaatttgaagttctgtatcttttagcccaaaggccaaattgggttattccaaagaagaatatctattgttcggtctgggagagtaattattatgatgatcagattccgtacaaaacagtggaacacgtagtatggaagatacgaaaaaagatggggcatgatattatagaaacattgatcaatgtagggtatagactaaaaaagatgtaaaggcaggatagtgtgagtaaaagtttttatattctgattgaatttttgggagatacgccatataatattggcaactataagaaagcgcgtacatacgtcatttgactaaatatcacgttgtaactagaaattgagataaactcttacagagcttttgtggactatccaaagaaaaaggaggctgactatgaacgtatatgaagaaatagatcaggaaacaatgatgttgcttttagattccttgtgtaaacggacagtggagggaaaacagatatgggaaaatatggagtataatcctatttcctttttacagaaagatatttatgaaaaagaaggtacctgtatatcacaaatgtttgaagcaacgacagtgttcaataacattgaatatgaattagagctttcagagtcaatcgaacttccgtctggcaagggagatatttttggaacaatttcttatgaaacagaagacggaaaagagaatacgtatgatttctctttgtcttttgatgtagagaaatatgatgatgcgaatgcggaagaattgcaggggatttttgggagctcaatcattgtacagtttacagatgcaatagtgggaatatttgaaaattcagatgcggtagctgagggatttgcttatgcaagatactatcatcaaacaggaattgattcggaatgggaaaccaatcctcttgtgaaacttggtgagaaactgatgcaagagcacgcaatgctggattttcataaaatagtattggatacagcttctagggagcgtttattgaaacggtaagtaacgggttataataagatacaaccaatcaattttttgtggaaactattgatatttcttagggtatcgcatataatataattaagccaaaaggtttcgtgtagcggcacgtaaaagctgtactgtgcccgggcagggtaattactgggactatttgatactcggaagggtattacgcccacaccagggagatacggtgagtccgcgccggggactcaatgataccggcgacattttagacattcggaaggatgtcgcggctgacagccagcataaaaccgctttttaagattatgggcactggataacaaaaaagttgtccagtgctgtttttttatactatagtgatgattgggaaaagatagatgggaaaacaacaggatagagagaaaattgtacaggagattaaagtagctgctgatctgtataggaagcatttagtaggtaaaagatttctatatgtatttgaaggcagatatattgaggtgctttataaagctgccaattttaggcacttgacaggtgtggccacgaacctttcagcaaaaaagttttatagttatgcagcaaaaaaaatgcttcaggcttcgcagatattttttacaccgcagcaccctttttcattgtgtaagcgtaagattaagcatatcggacagattgcaatgctggctggctcagaaggatttatgctggaagagattgtcacagacacgagaacttataagtttggcacaacagatcttaattttactctatgcttaaataaagagtatgatgataaggggcagcaaaagggcgattgctttgtagtagaatcgctgcgagatgaagattgcttttctaaaagtagaacagcatatacagtaactcatattttttcagcgccgaatgatgcgaaaaaatatacaaatttactgtttttagatgaaaatgcaacggtagacggtcttccagatgaaattaaaaacatgctggatcaaactttactacataaataaaaatggagagtacaggtcttggcgtatagaaaatactgcaggatcttcttacgaaagaattttttaagatatgagagaaaagaggtgctttctatatggctacatcaagtatccttacagagcttgtgattgaagaccccaaaaaggcagaagcatttattaatgcactggaactgtccagtcaagatccagtatgcagcccgtctgccccgttcattcccatattagatagtgtggaagagatacggaggttcctggaaagaaaaaacaagtaagcctatgtattggcaaatatcttagatgaatagaagctattggagaggagtcgatatgtgacgttctctccttttttatgcctaattgaagagataatgcagtgctttttcgtaaatggtgcaaaaatcgttttcaactcgttcagatataataaatctctaaaaccaaaaaaggaaagaaatggtaatgaaactgggaaatcttgcctccatagtccattaccagggaaaggatttgtaattataatagagcctgtaatcaacgaggagataaaagaatgcagaatgaactttatattgtagcagatgccataaaagccttgcgggaatccaggggactgactcaggagcagcttgcagagaaagcagatatttccgtatcacatctggcgaagattgaaacacatgccagacttatgggaatgaaaacttatatccggctgttggaagctatggatattcccataaaagaacactttatacacatgggtacagcgaaaaaagatatgatgttgaaggaaaaaatctggtatctggtacaggattgtgatgaaagagaaactagccttttgatctattccatagagggaattaagaaagggctaaagaaatatcagcaagacagcaggaagtgagaatacagatagggaggaaaagggaaatgttatcaagagaaaaggtggaagcagtattatttaaaatgggaatgcctgccaatgtaaaaggatttggctatattgtagacagtgttttgcttctggaagaagacagcaagattaaaacgacatatctgtattttaaggtggcccagcaacatggcacgacagggcagcgggtagaacgggcaatccgccatgcgtttgatattgtccgaagctgcagaggtgattatgatgtggtgaaccattatatcggttttatcaactgtgccaattccccttccttatccatgctcacaatgaagatacgggaggaagcactggaagtaccggaaccaaaaccggaaaagaaagaagagaacgtgattacgggaattaccgaagaccggcttttggagttgatgcggcaggcatgtacggaattttgggcagatatgattatccggttaaaaaaataaagagaaatgcagaccgaaaacagtctgccaaaacacatcagggttatggtgtcttttggcaggctgatgttttcagccgggaagaaccttgaaaactgaatatcagtatggtgatatttttttaaaacaaacgtgtcatttctgacgctaatctatagaaatatcttaaaggacacaaaacatttcggcacattctattttgtatgatgcagggtcatgagctgtgcgaagatacacttgtccgcagtggcagcaggtaaggcagaaaagaagcagatcaaacaaggaatcgtagaagatgaagggaaagtgtgagcagcgcccggacataggctgtgggtggcaggcagtctgaaagccgaatgataatgatacctttgcataaaacactgcaaccagggtagcgtctgggacatgctgcagcgggaaagggtgctgcagggtgtcaggcggccagccgggccggtcctacatgctcccgttcacaccggggtgagaaaataaaaaacatgctggcagggaaagccctgccagtatggtgtgtaaaatgggttcattttagggctatggggaaacgccggtttctttatagccctggaatgaaaacaggagccaaagaaagaggaggcagagcaatgaatagagagatgttacaaaaactgttttcagaagataaagagatctttcagggaggaatgttattccctgcatggatctgcaaaggaaaaaaagagatagaaaataggaacagtccccagcgggcggcagtgtatctggatattcccattccatgtgccgggcttttgtattatgaaaaagaaaaaagcctgcattactgtgaacagcagacataccatgtggttactttactggaaggtgtagggtgtggtaattccatagaaaaagaaaactggcagaggctggcagtgcttgcaggaaaaggcatgattgatgtgattgtggtatccgggcttagcaggttatcctattgtccggaagaaattttacagactatggaactgctccagtcttttcaggtgcagatagactgtatcggttatgggattttagattatgccagactgaaacaatatttaatgcacacctgggagaaacaggaacaatttgagcaggacttagatgcgtatctgtgcagttgctgtaccagggaagggatataatgttctcgcgggaagaactgctgaagatgcgggaaatgacgtttgaggacattgacccgaaagagatacaagatgtagagaaactgaagattgatgtaaaaaaaagcaaaccggagaaggtccgggaaatcctggagtccggaaagaacccttattttctgaaatataaagggatcaccataaagattgggtttgcttctaccaaccgtaccatagaggaagccatgcaaagccttgtgcagatgaaatggtaaagctacgacagggatagggaagaaagcggattgttggcagattacagggtggacaaaccttctggactatggtaggatgatggcaaggacccagtagcctctatcatttagggaatcggctgacgaatctaaatgataggagcgaatacaatgaagaatcaaatacttaaaaaaatctatcgtgcggttgtttacctacgcctttctgacgaagatggtgataacagggaaagcgacagcatatcaaaccagaggatactaatccatagcttcttaaagagccaccctgaaattcaggtggtaaaagaatgtgtagatgatggatataccggcacaaactttaaccgccccggttttcaggaaatgctgcgtatgctggaagagggggaagcagactgtattattgtcaaagacctttcccgttatggaagggacttttccggtgttttacagtatgtggaacgtatcctgccgaaaatgggtgtgcgcctgatccttgtcaatgacaattatgacagcctcacgccaaatcgtgatttccttaccctgagatttaaaagtttaatcaatgacctttatcctgcggatacttccaaaagtgtgcgttctcatttgtatgtcaaaatgacagccgggcagtgtgtagcgccttttgctttttatggttatctgaaatccgaagaggataaacataagctagttatggacgaagtggcagcttcggttgtacgggatatttaccacatgaaaatgcagggctgcagcctaacggatatatccgaagaattaaaccggcgtgggatcttgacgccccttcggtataagcaggtatatttaaaacagaaattaaagacagggttccgtctgacggaaaaaccgatctggatgccaactatggtgcgccgtatccttcttgatgaacgctacaccggagtgttgatacagggaaaaaccacaacgccaaaccataaagtaaaggttgtgatccacaaagaggaagctgagtggatacggtatgaaaatgcctttgagccggttatcaacagacaccaatatgaagtggtaggtaacctgatgaaaatggataccatgaggggtgcaaaggggctggcgcttctttcaggcctggtaaaatgtggggactgtaaagaaagcatggtactgaaaagcccagataaagtccaccactattatgtatgttcgacgtccctttatgaaaagcagtgcagttcccatagtatcagtgagaaaaaactggtaggggctgtgacagaagcaatcctgcattatatttctgttctggtggagttgaaggagatactggcgtatgtaaaaactgcctcaatcccaagacagcggcttttggaagaagacaaaaaactggagatgctggaaaaggagagccagagaattttaaacattaaagtaaaactgtatgacagttttgcagaagaaatcctggaccggacagaatttgaaaccttcaaagcaaagtatgaccagtctttagaggaaatccggcaggcaatggagtgccagcaaagggaaatccgaaacttgcaggaaacccttgaaaaacagcaggagtggctggaatattttctggaataccgggaccggacggaagtggaccgcttaatgctggtaaatctggtcaaacggattgaggtatatgagcagaagcgcattatcattcatttttggtttgaagatgaatttgaaaaggtattgggactgctggaaacagtaaacaggacaaagccggatcagcgtgtggaagccttcctgaaaggaaagggggcggaagcaagtgcctaaggtaagcaaaagaggacagaaaagacaaaacagtaagccggaagttaagtatctgagaacctatatttatgtaaggctttccgaaaaggacggagggcatggcagaagagattccatttatatccaaaaacagatctgtgaagactacgcaaagaaacacccggaaatgctggtggtaaaagtctatgcggataatggtgtgacaggtacaacgttccaaagggacgcatttgaagagttgatggaagatgtggcaaataaaaaggttgactgcatcattgtaaaggattttgcccggtttggaagggacgccttagatgctgtagatttgattgatgtgattttcccaaccttaaatatccggtttatttccgttatggacgaatatgacagcgcaaacccagcttgtgtagaaaacaggacccccaatattttgaaacactttatgaatgattattatgccagggaagtttcagagaaactggtacaggcgcaccggctgtccagggaacggggagagttttggggttccagacctccttatggataccaaagagcagaggaaaacagtaagaagctggtgccggaaccagaggaagcagaaataatccggcagattttttactggtatgtgtttgaagaaatgtcaagctatgatatagcaagggaactgaatggtaaaaaggtattaggaccggaggacagctaccagaaaaggaaacagggaaaggagccggaaaaaaggcggttatggagatcagacggtatcaggaagattttacagaaccccgtttatataggtgctgctgtttatgggaaaacaaaacagatgcttgcgcagaatattccccttcagatgataccaaaagagcagtgggaagtgtgtgaaaatgcctgggaagcagttgtggaacgggcgatttatgagaaagcacaggaaattgcaaaggaacgctggaaagatacgttggataactgggctgcaaacccaaaagaaaaacagggggcagatggcccttttaagggaaggattttctgcgggcattgcggaagacgtcttggaagaagcaggagcggaggtaatgagaaacacaaatatatggtttataaatgcccttccttttcccttacagatcatacggaatgtttccggacggtgaatgaaatttacatcaatcaggcagtcaaggcagcactccgctaccagatccagcttgctgtagaaagtaagaaaacctatggtgcagagttttatcaaaagctggagcaggaggtagcagaaaaaataaaaaatgccagacagaagtatgagaaatatggaagaaaactggaaaccttgtttgagcattatgctaccgggctgttggactgcaaggaatatcaggagattaaatcaatctatcaggaagaacagcaagcagccaggcagaatatgaagcagatacagcttcgtggacagcacctgttagatcaggtgaaggcaagaatggattggacagaggaacttctaaagtaccaaagatttcagaagatagagaaaggaattgcggaccgctttattgaaaagattacggtatattccaaagactatgtggaaatcgtgttctggtttggggatttatttgaaaaggagctggaaaaagaactagacaatatggaaggaggtcttccgtatgcagtgtgattttgtttttgcttatctgcgtctttccagagatgataaagaaaaaatggaggaaagcaacagcattaaaaatcaaaggcttttaattcagcactttgtagaaaaccagccggagtttgcaggggcaaagtttttcttctttgtagatgacggttacagcggtacaacgtttgaccgcccggaatttaagcgcatgatggggctgattaccaggagaaaacgaatctgtatcattgtcaaagatttgagccgcctgggaagggataccatagaaacacaaaactatatcgaaaaaatatttccgttccttggggtgcgtttcatttcaatcaatgatttttatgacagcagccagaaaccttccgaaagaaaggatacggagattaaatttaagaacctgatcaatgggatttatccccagatttgttccaacaatatcaaaaaagttatgaggaaacaggctgaaatgggacaatatcatggttcaatcccaacatacggatattgcttccatgacggtgtgcatacaaaacttcatttggatacggaggcagccttcattgtgagaggaatcttcgatcagaggttagcgggaatgagttatgcagacattgctaggaatctgaacgaaaaagaacttgaaacgcctacggtatatctacaaaggaaaggctgggcgccggaagcaaagaaatctgtgaaattctgggacggaaatttagtaaagctgattttgtttaatccggtttatgcaggactgacggtaagagggaaaacagaaaccagggttccgtcaaaaagagagtaccgatatatttcaagagaggattggatttgcgtaaaaggaggacacgaagcgattgtaacggagcaggaacttcagaaggtccaggacatggcagagaaaagaagaaaatattatgggcggacaccgtcttctgagaatattttttcaggtttgatccgttgcggacattgtggtcggaaaatgagaatacgggtgacatacaaagaaaaaccgatttattgcggaagcactacaacagccccaaacgcttcctgttatccaaagaaatataagcagaaagacttggaagaactggtgctagttatgataaaacaacaggcagctcttgcagaggataccataaagcagttaaagagagccaatcagactttgaatattccgaaactccgatatcggaaaaagcaatatgaaaagaagttggcgatttgtaaacaggagaaaatggaattgtatgaacaatatgcagaagaacagatttccctgaaggactacttggcacgaaaacaaacttgtatggaaaagacagcagcttatcagcaaaagatacaggagatagaagcaaaaattttaaaaggggaggaggaaaaacaaaaggagaaatcagaggggctgcaactttttgtaaaatataagggattggaagagctatcttatgaagttctgcatgagctgattgaagtcataaatttttatgatccggaacatattgaaattgtatggaaatacagggacgaatttctggaagcagtaggataagaaagaaccgggagagcttattgtcctggattccggtagagaaaaagatttcataaaagaggaggaaaacgctgcggtgtcttcctcttctttgtatcagaagaaaatttggcaaagaagatgggggaagagccatgtatcttgaaacatattctatggaagaactgatggaactgatagaagagaaaggatactgttctgtggaagcagtggaaatcttgaaagagatggaacaggcaaaaaaagagtatgattttttactccgggattgtgagaaaaaagagtggaaaacagaccaggtggtagttgattattaccggtatcttttggaagaattgcggaaagcgttaccctatgatgctatgggagggcagcatacgattccgattttggtgttacaggagttccgtaaaccggacattgtagaaaaaatcagagattttattgtctgtcaggctggattttccgattatgctctgttacaggaaatacagaaatttattaccgtacatctggatccgcagggaattatcctctatatggatgtactggggaatcagccggtagcaaggaatgcttacaaacagggaggacaaatgtggtaaaagaaagagtattagcagttccagatacaagcatttttattgcagagctgccggaagcaaccagaaatatcatacggaaagatttagaagaacatgcaagggaacatcattaccggctggaatgggaccgggaaagtaaggactatgtggcaatgagccggagattttgcgatatggaaaacatttatacggatacatttctgcatttctgcgagacaggggaagatatagagccctatgaaaaaagcctgaagcggaccatttctatcagattatatcaagatgaggtagaagaactctgtaggaagtctggaaaagttgggctgtcaatcggtgaactgtttgaaaactttgttgcagatttgatttgtggtacacataccaatggttctgatgaacgcatgtatattgagcaatggtttaaccggtgctatttcagtattatgccagaggaaacatttttatcttatctgcttgaaatgcgggagatagacagtgttttggaatgctgggaaaccttgcaagagttgaaggaattggaagagccggattgttatgataaagaggaactagagatacagcagaacactttggaagaatattttcaggaatatagaacctatacaagagaaccgacagaagaccagttggaagctgctatggaaaaggtgctggaatggaataaggaaagagagcatttgttggaagggactgttccagagaagtctttggggcggtagccggattggagaaaggaagaaaacagtgataagtaatgcggaaagaattgtgttaagaaatatgtacccaccagggtgtcgggtagagttggaagatatggaggctgatccgtatgtaaaactgagtcccggtgatttaggaactgtacagtttgtagatgatgccggacagattcatgtatcctgggattgcggacacagccttgctatggtatttggtgtagatcattgtagatgtgttatgagggaggatcgtttgcaggagatattacaaagagtacaggctatgccatttgagagtttggaaaaaatggaactgtatattacagaaaaattatcaggggctttccctaaaatcagctttcaggagagagaagggcaggaggttattgcagatatgggagttgccgcatttatgaagaaagatcttggtgtagcaattcaatatgaagctgacagtcagcaacacatctttataaaaaagatggaaattcaaggacaggaattggagaggaaaaatccttttccagtacagaagaagcgataagaatgattttctttaattgcaaaaatcgacaattttttttggatattacttgacaggatagggaaagactactctgctccatgtgctgaccggggttgacacaccggacgatggagaaatcgtaataggaggagaaacgttttcacggcttacggaagaagagaaggcattttttcgcagaaagcatatgggaatgatttttcaggatttccagcttttggagagtttgacggtaaaagaaaatatattgttaccactcattcttgaacgaaaagaagcagacatccagcaagagcgtttttcaagaatagcggatgtgctcggcattgaaaaattagctgacaaaggaattacggaaatatcgggaggtcagaaacagagagttgcgattggcagggcgctgatcaatgaaccggatattatttttggagatgagccaacaggaagccttgaccgaaagaccaccggggatgtgatgcgatgtatgaaacagatgaatcaacggtctggcatcagctttctgcttgtgacacatgatgcttatacggcatccttttgtgaccgggtactttttctacaggatgggaatctggcaaaagaagtaaagaaagagaacactgccgataatttcagagaagatatatggaaaacgctgtgcggtttgggaggtggaaaagatgaccttttttgatatttcccgaaagatgctgaaagctggtttttacaaatatcgattgtactttctatgcaatttatctgcaacggcattattctgttgttttgcagttatttccacaaacaggacgtttatgaatgcgtcgattgtaaattcatcaatatccaataacgtttatcttccattttttctgtctgcagtgtttctggttttttttcttcctgtttcgtgtcaggcatttctggcatcaagaaaacaggaatacggagtgatgttttctcttggcatgagccggaaggaagcgtttagaaacttactttttgaaaatgtgatcatatccgtgctggcattagcaatagcacttgcggcaggaactgtgctgtcatttttatttttttccgttatcatttatgcaatagatgttcacggagtgcaatggcagttttgcccggaagcatataagcttacagcagttctatatacagtagtggtggcagttgcctttatcctgaatgccgggagacttatgctggataaaatcggaaccctgctaaaagcacaatatcgggcagaaaaaacaggaaagattggtacgttcttatgcagacttgcacccaactacatgaggtttcatctggtggaatggtcatttgtccgcagacacaagaaagaatggggatgtaggtatgttttagcctctctcataatagcggtatctgttatgcttacgggggtatgtgtgactttatatccggcttttctacaggatgcaaaaagttattctccctatgacatggtgtactcagaaatctatggaatgaatcaggtttcagtacaggatgtccttcatatattggagaaaaatggtgttactgtagaacaggttattcagcttccctatatcagagatgatgtttttaattaccttcctgtgacagaaataaaccgggattttggatgtgattatcagattcaggaaggcgagtttttgaatttgtttcagtacaatttggaagatgggtatgaacataacatacagccagtatctactgtaacgatttccggggacagaaagctgcagtctgttggaacagatgtaaagatactgtttaatcaaaatccgacctttgcagataaaacactgatcatcaacgattctgatttcgaaaaattaagtgcagatataacaggtagtgctggtatcgcaaacttgtttcagtttcagaattgggaagattcttatgcgggagtatgtgaagtaaaagaatatctgcaggaaagcaatcagttgaatgaagatgagcagacatattatgaattgtcttcgaaagtggagaaataccaggatgcaaagaaatcaggacaatttttattatttttgatggcatttgtgatagggcttatgataatggctgagtttctgttaattcattcacgtatccaggcagagaaggaagaaaatagcagggtcgtttgtagtttgcgaatgttgggaatgatagacaaggaaatggtaaagtgcctatgttataagaattttctaagatttataccgccatcggttgtgggaacaatcctttctttcctgccatcttattatctgaatgagagttatggaatggggacgaatggaattctggcaggaatcgtatttggagtgattttgacagtcggaatattcgtagtgatacgcaggtattctgaaaaagaagaaaaactttatgaaagcggttttataatacaaggaagaggatttttcgagaggattttttgattatagataagtagaaaaagattcaaatcctgtgtataattaaaagataaagatagagacaactcggaatttcaggaggtgtttttatgccacaaatgaataagggaggaaaatttattttcgggaaatcactcattcggacggatggaacattgcggattccaccgcaggcaatggaagaatatcacattgcagatgaaggaaaagtatatctttttaccggaagtaagattaccggtggcttctgcgtcacccggaaaggccttttgcatccgtcaaaacttggtcacattttggacgatactccaccgttgcttgactactcagcaggttctggcgaatttatcaaatacaaggggcgttcctactgctgggtagagatttcacaggaggggcaaattcttcttacgaagaaaatgatggattttttgaaggtgagacccggaatggagctgctctctatccgcagtagcgacatcgcgtttacgatgggagctaaaggaccgctattggaaaaagcagaaaactatgatggtgaaattccgcttttttaagtgtaacaatttccagttgtgcgcccagctaagggtgtgtagtcaagccggtggaattccggtttatccaaggtttagccaaccagataatagcgagtcttgggatgatgttccaacagcttgtacattttatcatatctccaagtcgttgtcaacaacttttttatttttctttgttgtctctcaatcgcggcaactctgatatcttatcatgtctgtcgctttttgtcaacaactttttgaatctttttatttgattcaaagcggagaaggagggatttgaaccctcgcgccgctgttaacgacctgcaccctttccaggggtgtcccttcggccagcttgggtacttctccatatagctgctcaaatcattttctctcccgagaagttatgatattgacacagaaaaagaattctttcgaattctttttcaaacggcttaaccgcctagcggagaggatgggattcgaacccatgtgcccttgcggacaaacggttttcaagaccgcctcgttatgaccacttcgatacctctccgtattctgttttcgctgttcatctgaatcagcgcaagacatatattaccatccccggctctttatgtcaataacaatttttcattttttttgctttttttaaaaaaacttctgcaattaacaaatcttccggtgttgtgaccttgatattctcgtattttccctgaacaagcttgactttatgaccggtaaaccgttccacaatcattgcatcatccgtgatcctttcgccggattctgccgcctgccacatttttccatatgcatccattaaaagcttataagaaaagctctgtggtgtctgtaccgcccacagacagcttctgtccggtgtatccacagcataatgttttgcatttcccactttgatcgtatcttttaccggtacaccaatcacacatgcatgctcctcttctacggcacgcatggacaaccggatttccgtttcatcaatcatcggacgtgccccatcatggatcagaacatagtcggtgcccgcagctgcttttaatccttcatatactgacagataacgttctttgccgcccggaatcaccgcgcggacttttctgaaatcacaagcctctacaatttcttttctgcaataggaaacatcatcttttcctgttaccagtataatatcatctaccggactcttttcaaatgcatacagactgtaatagaccagcggatgtccacacagttccataaactgtttgggtgtatcactttgcattcttcttccactgcctgccgcaagtacgatcgctgtatagcgtttcctgttttccatctggtcattctcccaatttcagattcggaacagcgttcagatccagccctgcacgttttcccgcaataaagtcataatatgccgcagcacctatcatcgccgcgttatcggtgcacagaatcggcgaaggatgataaaatttcaccccttcttcacggcacatctgttccatggccgcacggattactccgttggatgcaactccgccggcaattgcaaaactgtccatatgatattcgcggattgcatgccgcgcatgatccaccagcacatccgtcaccgactgctggaatgatgctgcaacatccgcctgattaattggaagatttttcatcctgcatccgttcagataattcagcaccgcagactttaatccactgaaactgaaatcatataccccatctgcaatctttgcccgcggaaaggaaattgccttcggatctccttcatgggaaactttttcaatttttggtcctcccggatatcccagcccgattgcgcgtgccactttatcaaatgcttctcctgccgcatcatccctggtccgtccgaggatttcatacgttccgtaatccgtcactttcacaaggtgcgtatgccctccggagaccacaagacataaaaacggtggcttcagatcaggattttcaatataatttgcgctgatatgtccttctatatgatgtacccctaccagcggaatgttcgcagcatagctgatcgccttggcctctgccacgccaaccagcagtgcaccaaccagccccggcccgtaagtcacaccaatcgcatccatatcctgtaatgtcatatctgcatccgaaagtgcctgtgcgattacctgattgatcttttcaatatgctttctcgatgcgatctccggtacaacccctccatataatgtatggagagcaatctgtgaagaaattacattcgaacgcatatcccggccattcaccacaactgccgcagcggtttcatcacaagagctttcaattgcaagtatttttatagtctgttctgtgtcactcatttttattcttcctctgtcgaattccctttgattttataaaatgtacggattttccagtctccgttatcgtcttttctaagcacatacatctggtaggttttatcaaactttttattttcttccgtaaaataagaagctgtgacatatgccagtttatccccgttgctgtcatccgtcaggtattttacatcatcgctgtcacatacattggtctgacggatcttaaaggaacggttcttgtaatctgcaatgctcgtctccaccgacttcttgtaatcatccttggaattgttatcggcaagatcctgatcaaaaagcatacgcgcctgatcaatcagcttgtcgaactcatcatccgtataatttccggaataataactggtaatgatctggttatacagtttaatcactgcgcgcggagttttcggataatcatccgtcagatttttttcattgattctctgaaccaccgtcagattttctttcgatgcctgtgaaccatcgctgtttttcatgaaataaaatcccacgcacaataaaacaacacatactgctgctgcaacggtaatcccaactttcttcatacgcctattcctcctcaaatgttaattccacactctttccatctttgccaaggtatgcatttgcgaaaatatcccgcacctgtggcatgtaatcctccgcccttaccagagacggagaaaaatgggtcagccacagttctttaacttctgcacgcttcgccatatctgcggcctcataaaacgtcatatgtttgtactgttttgccttatttagcttttctttttctgcatacatgccttcacagataaataaatccgattcttttgcagcgtttacaatggtatccagtggacggctgtctgtacaatacgtcactttcagaccttttcttgccggtccgagtaccatctgcggctcatagatcacaccatcctgctcgatggtctcccctttctgcaggcggctccataatttcatcggaacattctgttctctggcacgctccaccgaaaaacgtcccgcacgatggatttccaccgaatatccgtaacaaatgacattgtgctttacacggaacgcatgaatgtcatatccctggatagaaaaagattcttccggctgtgtcagttctatacaattgatctcaaacggaagttccggtgcaattgtccgcagtgccgtcacgacacgtgtgagtccttttggcccgatgatcgtaagcggttctgtccgctccgcatttcccatcgtcagaagaagccccggaagaccgctgatatgatccgcgtgaaaatgtgtcacgcagagaatatcgatcggtttaaaactaagacctgcttctttaatagcaatctgggttccctcaccgcaatcgatcagcaaactgcgcccattatatctgagcataagtgatgtcagccaccggtacggcagcggcatcattcctgcagttcctaacaaacatacatctaacataattgtttccactccataatatctgcatcctctctgggaaactgataaaaattttttcgcacaccgattttttcaaatccatacgtccggtataactggatcgccggttcgtttttagaacgaacctctaatatgatcctgtcaatctcatgttctgccgcccattgctgcatcctaagaagaagctctcttccacagccttttttacgcattttccgtgtcactgccacattggtaatctctccctccggcggcatccggtacatgccaatataacctgcgatctgaggatcttccaccacgaaaaatatggcatctttcattccatccaggaatccctgttcactccatggctgggaaaaacattctttttcaatttgtgcaacagccggaatgtcttccgcggtcatctgccgtattctcatatgcgaaaatcccttgccttttcctggcgttctctttccgcctgcgacaggcgcagataatccggcttgtgtgcagctgcatcctccgcctttccctgacggtataaaatgccgccgagtaccgcaacacatgccgcacgctgcttattgcaatgtgcaggtgcaaacaggtatggtacctgtaaattttctttcaggtaatcggcaaaaaccggcacaccatcgcccaaaaatacggttttctttccactttcattgatctttgcggtaatttcatcgattcctaccgcacactgcggaagaagtgtctgcatctgcccatcggagaaagtatatagtccggtataggcctgctgccggcgcgcatccataagcggacatacctgatcctcacatccccacagattatatgccagggcatccaccgtcggcacggaaacaatctgtttgttcagggcaagagcgagtcccttggccgtcgcagagccgatcctgagtcccgtaaaagatccaggtcctgcggacactgcaatcacatcaatcgtattcagatcaagttctatcatttttgcgacttcatccaacattggaagaagtgtctgtgaatgtgtttttttatagttaattgtatattctcccagcagattgtcgtcttctgtgaccgcaacccctgccaccagtcctgagctgtccaacgctagtattttcatattctgtcctctatctgtctaaaattgttatttttctgtagtcgaaacctttttccagatctttttcaatggtgatctcccggtaatgatccggcaatatctcttcaatcagattggcccactcgatcatcgtcagaccctcaccgtaaaaatagtcctcatatccgatctcgtccatctcctcgatatccccgatacggtagacgtcaaaatgatagaacggcatccgcccctcttcatatacctggacaatggtaaatgtcgggctgcagatcggctcttcaattccaagtccctgtgcgattccctgtgtaaaaaccgtcttgccgactcccagatccccgacaagtgtatatacatccccaggccgtgcctctcttgccagttttctaccgagttctaaagtttcctctggggaaaaagtttcaaattctataacttttttatcctgcatactgcctctacgccttcattctgagtttatatttttccagtttctgttctgcaagtgtccggaacgctgcatactgatctccaatctgctccataggaataatatatgcgcttttccgattgctgtagattaaaatctgctttgcattcgctacaatcttataaattgcctgccactccatatccccagtttcttttccctgggatacatgaatatttttctctgtaatttcataatgcagtgtgccggcaagcaccttgtttgtcttcagggtctccttcgcacgaaaccacagtgcaaccgggatataaagaagaaacaaaaatcctactgcaatatagagcagggtgtaagatgtttttccattctgaaaactgattccagccataacaaatccaagaattccaagcgcaatggaactccatccctgaaacccggtatacgtctggtacatattaaaccgatacaggtcttttggtgataatgtaacatcaaatgacgctttcatgccttcttctcctatccaaaataaatgataaggctttctgcgtatcacacagaaaaccattacgttgtatcatattataacaattttccaaacaaaagaaaagagaaaaaaaaggagcaccccacgggtgctcccaaaaccatttagtattcacttaaacgtccttttaaaactggagataacggtttgtaaatcagcatacagatgacaactgcaatcagtccttttacaattgtaaatggaagattaaagcagatcaggcactgcagtacacttttcatggatggtgcaattgcctgatacatctgcaggatggcttcctctgccataccagccttgtaatataccgggtaaaccacaaaataattggaaaacacactgactattcccatgaccaatgctgcaaccagaccactgactaccgcactctttttggtctttttatgtttgtagatattacctgcaattgccacaaatacggctccgagaataaaattggaaagttctccaacaaacatactgtttgaaaatgccagatggagaacgttcttgatcagacagatcaataccccacacactggtccgagcgcaaagcttccaagtagtgccggcagatccgaaaaatcaaatttgataaatgatggcatgatcggaatggcaatctccagatacataagcacgaacgctacggcagaaagcatcgctgtaaccgtaatatagcgtacttttgtattcatgcctccctgctttactgctgtctttgtctgttcactcatacgaactctcctttcagaatcaacggaattccagaggagtgttgcctgcatatatgatcaggaaataaaaaaccgatagatttctctatcggggttctttttctatcatacagtcaacaatgcaaacattaatttgcactttttcttctctcatccagactatactgtcggtaccggaatctcaccggttcggctgcaaaaagcagttcacggactataccgtcggtcgggaatatgcgtcatccgcagcaccctgccccgaagaattccttctttatttttcatcgttattatattcacattgtccgaaaatgtcaacaccggctggactttttcccatccatttgctaacataatttccatgaagatttcaaatatattacgcacggacaaaactttagatttttctttttatatcatcggctgggtgtgtcttattctcgcactcgtgctcggacttgcatggaaaaacggttatttcctgtggatattccctccggatggctgtgtcctgcacaatctgaccgggtactactgccccggatgcggcggcacacgcgcaattcatgccctgctgcacggacatattgtgcgctctttcttttaccatccgattgttgtgtataccgctgtctttttcggctggtttatgctgtcccagaccatagaaaaagcatcccgcggacgttttgccatcgggatgcattatcgtgatatttatctgtggatcgcgcttgccattgtacttctcaactggctggtcaaaaatctgtttctcgccgtctttggcattgcacttcttggataaacattctatttctgatttttcagttcctgttccagctcatgcggacgcagatccacaccgcgagatgcatctccttccgggtcttttccaaatgcataatcatttcccggcagaatcgcattgagcacgattccggcaatcgctgcgatggcaagggatgtcagggtaatggaagtgcttccgatcgtaaaggtcagtccatctgagaatccgagaccggaaactaagatcacacctgcaataatgaggtttctggacttggtgaaatccacatggttttcaaccacatttcttacaccgatagcagaaatcataccgtaaagaataaagctgacaccgccaataatggatgccggcatcgaagcaataatctctgctactttcgggataaaacttaaaacgatcgcataacatgccgcaagacggacaaccttcggatcatgtacacgggacaactccagaacgcctgtgttctctccataggttgtatttgcgggtcctccgatcattgcagaaatggaagttgcaattccatcaccgatcagggtacgatgcaatcccgggtcctcaataaagttctgtcctaccgttgcagaaatcgcggaaatatctccgatatgctccatcatggtcgcaatggcaatcggtgccatgataagaatcgctgtaagattaaatttcggcaggataaacggtggaagtccgacaacagccgccgaggaaacgccggaaaaatttaaaataacagatccgtccggattcgtaaaaccaagtccctgcagaaccagtgcgaacacatacgaaatcactacaccgagaagaatcggaataatcttgaacattccttttccccagatattgaaaataatgatgaccgccagtgccacaattgcaatgagccagtttgtggatgcattgctgaccgcagacggtgcaaggctcagtccgatacagataatgatcgggccggtcaccaccggtggaaggaaacgcatcacacgttttacaccaacgcaccggatgatcagtgcaaggatcagatacaacaatcctgccacaacaattccgccacacgcatactgcagtttttctttatctgccatattggcaaatatcccggtatccagtgccgcaacgctggaaaagcctcccagaaaagcaaatgaagatcccagaaaagcaggaaccttaaatttggtacacagatggaaaaacaaggtaccgaatcctgcacagaacaatgtcacctgtacagacaatacctgtgaggtactctgaaaatagctgtttaccagaatcggtacaagaattgtcgctccgaacatagcgaacatatgctgcagaccaagcagcagcattttcggcgtgcccaaaaccctggcatctcttataatgtctttttgttggttcattatgaaaaactcctcctaataatagtatattctaatatccggcaatcagccggagcattagcttatgtttgatgggatctccccgaccacatccagataaaaaataaccagtgtctgtgactggtatggatatacccagagtgacccgatgcctaaagacagcagacacagtatctgcaatccgataaagctcagataaatataaaataatcttcctttatttcccttcatgatctgacggctgatctttaatgattcgcgtgccttcatctgcggatgatccaaaagcagatacaatgccagtgcataccacatctgcacgaaaactgccagaatcgtgctcacaataccaagtatcaccagtactgcaatcgccgcaggagacttgtccaggacaaaaaataacacagcacctgtgatcacaggaatacagctgatcagcgttgcaataatcaaaagcagtcctgcaatgatataacggtccgggtgatttttaaacccgtaaaataccatgccaagtgtcatttcttttttccgtgcaagtgacagatgaagctgaaggattccgacagacaataccatgcttaaaagtgtgatcagaaattccgccacataaaacatgatcgtcaccggaagcggctgtgcatctttctgcaacatggaaaatgggagttctaccgccaaaggaatcagtgtggcggcaagaaaagctcccattggtattttataatttccatttaaattgtctcttgcgattcgttttaattctttgcaaggtaggttcatttgtttatactccgtttctgtaactgattgcttttctcattatagcatggctatgcagatgcaacaatctttttattttgccataaactgcttcatcagttcattataatccatgccctgcatatcagaataggcctttaaaaatccatcgatacttccatactgatggatggcataccccagaaccgatgcgtacagtccgatagccgcaaccaatgccataatccccagaatcattccgatctgtgctttcgaagtataagacatcatgcctccgcgggaaagtgttgcaaaaataaccgccagagccccacacggcacagcaagatacagacaggtgcagcttagtaatgcaattgatccaagtatcagggaagctgcctccatgcgtgcagatctccggctgcgatacggctgattcggatttggttgataagatgatccatacatatccataatacgttttcctttctttttaggattgcttttattgtaacatttcatatataatagggaaagtattatttgacaggaaaggactattaaggggaaaatttatggatattaatacaaaaattgcggaagaactcggcattcgaaaagaacaggcctccgctgccgtaaaactgatcgacgaaggatgcaccattccttttattgcccggtaccggaaagaagctaccggagcattgagtgatgaaattttacgaaatctctatgaccgtctggtgtatctgcgaaatctggaggacaaaaaacagaccgtactggcctccattgaagaccagggaaaactgacggaggaactgcgtgcacagattctcgcggccgaaacacaggttgcagtggatgatctgtaccgcccgtaccgtccgaagcgccgtacccgtgcaaccattgcaaaagaaaaaggcttagaaccactcgccaacctgatccttcttcagaaaatgacagtttctcctctggaagaagcaaaaaactatgtcaatccggaaaaagaagtggctaccccggaagaggcgttaaacggagcaaaagatatccttgcggaaggcatctcagacaacgcggatttccgcacccatatccgtgaacttaccatgaaacacggtcagcttttatctgctgccaaagacccggacgccgaatcggtctatgaaatgtattatgatttcaatgaaggactctccaaactggcaggacaccgcattcttgccatcaaccgcggagaaaaagagaaatttctcacagtaaaaattgaagctccgaccgatcgtatcctttcctatcttgaccggaaaataattacgaatcctcaggctttcaccgcaccggtgctgcatgaggcactggaagacgcttacaaccgcctgattgcacctgccattgagcgcgaaatccgaaacgatctgtttgaaaaagccgaagacggtgccatccgtgtattcggcaaaaacttagaacagcttctgatgcagcctccaatcgccggtcaggttgtacttggctgggatccggcattccgtaccggatgcaagctcgctgtggtggatccgaccggaaaagtacttgatactaccgtaatctatccgactgccccgcaaaaccgcgtggacgaagccaaagcggtactgaaaaaactgatttccaaataccatattacattaatctctctgggaaacggtactgcttcccgcgaatccgaacagatcatcgtacagcttctcaaagagattccggaaccggtacaatacatcatcgtaaacgaagccggtgcctccgtatactctgccagcaagctggcaaccgaagaattcccgcagtttgatgtcggacagcgaagtgccgcatccatggcgcgccgcctgcaggacccactcgcagagctggtaaaaatcgacccgaaatccattggtgtcggacagtaccagcatgacatgaaccagaagaaactgaccgaagcgctggatcatgtcgtggaagactgcgtaaaccgtgtcggtgtggacttaaataccgcttctgcttccctgctggaatatgtctccggtgtgagcaaagccattgccaaaaatattgtggtctaccgcgaagaaaacggaaaatttgcctcccgttcccagcttctgaaagtggccaagcttggaccgaaagcctatgaacagtgtgccggcttcatgcgcatcagtgacggaaaaaaccctctggatgccaccggtgtacacccggaatcctacgcagccacgaaacagctgctggaaacactcggctatacgctttcggatgtgacagaccgcaatgttgccgggatctcgaaaaaagtccgggattacaaaaagcttgcacaggatctggaaatcggcgaactgactctccgggatatcgtaaaggaactggaaacgcctgcccgtgatccgcgtgaggatatgccaaaaccaatcctgcgcagtgacgtgctcgagatcaaagatctgactccgggcatggtattgaagggaaccgtgcgaaatgtcattgatttcggtgcctttgtggatatcggagtccatcaggatggtctggtacatatctcgcagatgtgtgaccgctttatcaagcatccactggaggtcgtcagcgtcggggatatcgtggaagtgaaagttcttagtgtggatgtgaaaaagcaacggattcagcttacaatgaagatctaacattcaggaaacaatttttaaagagaggtcatatcctgtcatggttgtggcctcttttttttgtcaccctgccagcggattattgaccactggattactgttcacaggttaccctgcgaacagtaacaccgctggtacagattctcaactttttggtatttacagttgatttctgcatgcaaataagatattctgtctttaacacatataattccaaatctgatgagtcattcgctcgtttatccactggaattttaattcaatacaggatcaaaaacgactcggttttcccgtttttttcggttgtaaaactatgttgttttgatatatactaaaggaaaggcaggatactacatggggaacactgacattgtggcagctccgctgtcagatgccaacgagaaaaacactacagaacacagcactatttttgatgatgtattccggacaatcgcacagaaaatgccgcagcttcttattccgctgattaacgaagttttccacacttcctacagcgaggaggatcattttgaacagttgcggaacgaacattatgaaaaatttggaactgtggtcacggattccattatccggatcggcaaccatatttatcatctggagtgccagtcctcaaaagacaaaacgatggtcatacgcatgtttgaatatgatatttcaattgctattgagcacgcttcttttgaatcaaatgatatctgggaaattgaatttccgcagtcatgtgtactttatatccgcaatcaccgttcacttccggattttcacgaagcgattgtgaagtttgcggacggacagaaggtacgttaccgcattccgatcatacaggcaaagaaatacaccgttgaccggatttttgaaaaacggctgctgattctgcttccgtatcatatcttacgatatgaacactttttgaagcacaacgaaacggattcgaagaaagtgcagcatctgctggacgatttccgggagattaaccgaaagctggaggaaacatctgagaaggaacaaaagtcacatctttatatggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccgaaagctggaggaaacatctgagaaggaacaaaagtcacatctttatatggatatgatcgttttgattgaggagattgcggattatattattccggaggataatgagatcaggaaaggattgggtgaaattatgggtggtaagattttgaaattacgctctgaagagttgttggagcttggagaagccagaggggaagctcgaggggaagccagaggcaggcttaccggactacatgaagccaaaattgatgcaattcaaaatatgattgatcttggtttaaccagagaacagattttaagaaaatattctccagaggaatatgaagaggcgataaattctatgtcggtaaaagcatgacataatccgtctataactgtatttttcttatttctatgctatgagatgtattttaattatatctcatagcattcatgaaagaacattcgttcaaattaccattataattacaatttcatacgtttgatcataactgcttctgtttcttacactttccatattgtaaaaacagatgcttatgatatatactaaaggaaaggcaggacattacatggggaacactgacatttcggtaaacacgttaccagatgccaacacagaaaacacgacagaacacagcactatttttgatgatgtgttccggacaattgcacaaaagatgccacagcttcttattccgctgatcaatgaagttttccacacttcctacagtgagaaggaaccctttgaacagctacggaatgaacactatgaaaaattcggaaccgtggtcacggactccattatccggatcggcagccacatttatcatctggagtgccagtccaccaaagatgaaacgatggtcatccggatgtttgagtacgacatttccattgcgcttgagcatgcttcttttgcgaagcatgcgatctgggaaattgaatttccgcagtcgtgcgtactttacatccgcaatcaccgttcacttccggattttcacgaagcgattgtgaagtttacggacggtcagaaaattcgttaccgcgttccgatcatacaggcaaagaaatacacggtcgatcggatttttgaaaaacggctgctgattttacttccatatcatatcttacggtatgaacactttttgaagcacaacggaacggatttaaagaaagtgcagcatctgctcgacgatttccgggagatcaaccgaaagctggaggaaacatctgagaaggaacaaaagtcacatctttatatggatatgattgttctgattgaggagattgcggattatattattccggaggataatgagatcaggaaaggattgggtgagattatgggtggtaaaattttaaagttacggtcggaggaactgttggagcttggagaagctcgaggggaagccaggggggaagccagaggcaggcttaccggactacatgaagccaaaattgatgcaattcaaaatatgattgatcttggtttaaccagagaacagattttaagaaaatattctcctgaggaatatgaggaggctttgcgttctatgcctgaaaaagtatagtcagatccactcctggcacatacctaaaacctcctgtgtaatgcagatatgggcagaacccggaaaatcgggttctgcccattcgtaactattcacaaatcttatatcagtttttaacgtttacacaaaacttaaaacagtctcatctctttcgttctttccatcgtggaatacaatagcttctcctatgttttcctttgctgatgcgtaagttgataccaccgccttgcttcatcatcaagcacactctccacttcctgaatataaactctcttttcatcggttaacgactgagaatctgcgcattttattgcatttaccctttgaatctgtaacaagcgattacagttatttcggaataatgaccatttttccacactacgcgccataacaagaatggattctataaccacaatggcagcagaaacaattgccaaaattaccggatattttttcaccacgctgatcatctgcaaaacaggaatactggctgcaagcgcaattttaataatcgtaaacgcataataaaactgcttacacttctgcgctcttatgtgataatacttgatatacgattgcacaattttatcgtaatcatccatatatcccggataataatattgtgttatttcattttctttgaacttttccacacttcatttattcctcttcattttatccaccatctcattccaaacatccttattggataacatcatatctttgttctcatcgaaaattcctccgacatattttgtatacatatcccatataagctgcatatttcttcgggttgcttcatgttttgcatattttgaaacccatcgcataagatatccaaattcttctgttggatgcagccagtcatttcccatcacttctttaatgaaagcatcttttgttatgtactttcttcccatatgaatattataagcatttctctggctaaactgataaatccattctgctgtcatcggacgaattatataacacgtctgtttgtctatttgccgggatatataaggaatttctgtcacctccaaaagggaaaattcttctggatattctgtgaaaaagctgccttgtaaatcgctccatgaacgcagataaaattctctgagtgagttatattttttcccagttggtaatttcttttcaaatttccaaaaaactaccctcttattttctttttccccacgaacattaacagcaatcttttgtttttccaattcttctctatcctgtaacagtttccacagaaagttttctataataattccattctgtatcagataatagagtacatggtcatcttctttctcatttatattttcattaaatttccattcatcctgttccagatgcatatgctgcataatccatgtctgaacatccgtatgctgatatgtttttaattcctctgctgtataggaactgcgatcattcgatgcgaccaataatcctccacctttttcttttcgctgaaaatattccttatacacctccagtatattccgcttaatttcctttatggatatatctgccaaatttaatccctgagaaaatccttcgttttctctcagaaccggtgcctcctctaactttccctctaactccccatttgttggttctatttgttctacttcgcgcactgcttctgacaacacatcgtctggaatttttttcttcttaatactaatttgatacccatcaatcaaatctgtcttgtaatcttccaaatttttttctatatattcccaaaatatatccatatcactatccggcaaatataacatttgcaataagcgcatcttcatatcatactcacctgaatgctccaatgatgaatggaaatataactgcaaataacgaacgatatactcctccaaggaaaaatcttcccgaaattcattgcggtgaatctttaaatcccgttttgcctgtaatcccataaaatcgagtgaaatatccaaaacctcatccaaagccgataatggattttccactcctgtcatacgaacatttttatagcagatagtcatctttccattgctaccagaagttctctttcgaattgttaccaaaacttcttcttcacaatcccatgctttcaaatacaactggtttttggaaacattactttcattccacctagataatatctgatatcttttatcattccatgtcaattccttaacatggtacggcacctcgtttatgtagtatctttttttctcatacccttgcacatatactgcaatggcgatcaatggctctggaataatctgattcaaataactcagtaacacctttctcgtataacccttgatattttcttcatcaaatccaactttatctgcatacacattgctctcaatgttttgccgttccacttctacccgatcatatcgaacttttgttttgtcattttgcgcaatctcactattccaccgcaaaaaaatgtcaacaggaactttgatctctatctttgttccatgatgtcccaattgatattcctcagtgattacttctccacctgattttggtgcattcaacgtaattttgcgtccgacggtttcattctctgtctgcgtcatgatcgttaccgatgaggtcaccataaatgcagattgaattccaattccaaatccacccgttggccgcatccatcttggcatttcctgtatcatccggtcgtactgcctgcgtcctctccagcctgtcccaatgatagatatgactgccatgcagtcttcttccataccaatgccgcggtcttccaccgtaattaacagattgtcataatctcccggaatactttccactttcagttgtacttcatagcgatcatagatttcctttgaaatgtcaaatggctgcaaatttccctcttttgccagctccattattctttctccgcacaatccctgcataatatctttccacaactgcatccgtgtggcatccatcgcgttctgcagatattcccgtataaaatccatgcggttcgtataaaaattggctcctgccagcaaatcggtcagtttttccttgtctacctcaaaacgcttctgacggcccagatgataggcatgttttttattgttgctgtctaacaaatacacgtggcagtgacttcgctttaacgtacagccacgcagtaatggaggtgcgatttcattccagctgtaaatcagatcctgcacttcctgttcgatcaggtgaaaccagtcctgcgcacacttacatacctcgatctgatccgactcagcctctacctgaatctcctccgaggtaatgattatgtgactgattgcctcatgttttagcatatgcgtagaactcagtcccggcatctgctccatatgctccacggagtacagtgagaaccgattgttctctacatccagcacatccccaagccgaagcaaagcggctgtaaatcttggataaatcagttctgctccaattcctttttcccgataccgcaatcgttccatgatagcatcatatccatcatatgtatgcaattccgataccagtgctacaatctcgtacaatcttctcggcacttccgaattatcttctgcaactacacgttctcttacctttacattgcgtttgctgtgctgtcttcggacataatccgaaacgagccactttacatattcaacaattctgtttggccagcattcttcaaaaatatctttccggttcttgtcttctgtatgacgcatatttgttttgctgcgaagcagctcatccattttctgataataagaagctgcctctttcaaatccggatctttggatgtcagacaagctaaaagatattccttaaaatccggatcactccacaaatcatgtaattcttttccggtcaatgccattccgatgtcgtgggaatacgcagattccagtaaaagccataaatcccctctgctcaattttacaatgcgttcatctccgatgaccaattcgatcgtttcaagaatactgaccgaatggctggagtcatgtttactgtagtgtgcaaaatcatatatgatggtatctgtaattttacaatactggtctttgcggtatctccactcggtaagtacatccaatccccggttcatatgggcgcatgccatctcaaaacaatattctataaaggtatctgctttggaaagtttcacaaaaccactctccagacaacattcatgcatacagtctgctttgattgctgcaatatatctttcgttaaatctgcccctcattccttattcctccattatgtatggcatactccttgcaatgcgatccaaatccatattttcaaaataaccgtatcttacaccttttttttgttcttcctgcaggaatccccgcatctgtgcttcccattgctgaatatattgttctgtgtacttttgttttcctcctccagttgttcttccctgtattctatataaatttacataatacggaatttccagatattcttccttaaattgcttccatgcagcctgatcttctgttttctcatataaatacttatacaatgcaactgcataaaaagaggatacgcgttcctccgctgatcgtttttcaccaccaacaatctttacacgtctttccgttttccccggttctgtttcatatggttccaaatacaaagacagcataatccgaattccattttttacaatctccgctgccgtacgtgaacatgcggtcaatgtctgcacctgtgcagcataatgcttcatcttcgttacatttaaagcggcaatcatcgtgtgacacagttcttccatagggattccatccagataccgttctccttccggtgattccttacagttgccacgctctgcggcaatatctaacagatcacttaatatccatttcactcccggttccagttcacgaaagcaactccacgttgctactgctatttccatatcctaactcccattcatttaccaactgaaatatatgatcatattctctcgtatttccatccaggtaatccgcaagtaaatatctcacctgagccagttttttttcaatactccatatagacccttccggttctgtctgaaaaaaatcttcaaaaaaatacaatgaatatggatctaatccatactccaaaaaccgttcatgataaaaatatgtatttagtttttcaataaacgaatcatagtattcataaaaatcctttgctcctgtgcgtatatataacgcataaatatatggaaccacttgttttgccgtttctcccagaattttaacggcattttcccccggtcgaaaccctcgttttaccaatccatttttcgtatcatttacaatataattacgaaagcagctttcttcctgacacaacaaaatgatccttgtcactaccagtctccgttcttccagattcatatcaggtattacattcgaaagagagttttccatccactcaattgtcagaatatgttcaaaatcattgttgtcctcaaaacgctcctccgccaaccattcccgcacacaatacaagactgctttccaatttttatcaatcacttctttatgaatatgcgtttcttttttcatattccggatcagaagccgctgtttcatgatttccggatgttctgcaagtttttttagtgtatcaatcaatttctggggcgaatgatgcttcataaattcccagtcaaaatccaataccaaatcattttttttataaatttcattttctattaaaaattcttcaaattgctttccgacatataaactgaaatataaaatattggcgcgatataatgcccgatagaaattacagtttttttccatcagtaacagcatcttttctttcggaaattcgttattatcctcatcaacgggttctccaagcagtctgttgatggtcttttttatttcatttccataatccgtctgttcatacaggcggcaaaacagttcaaccacttgaaaataactcatagattttacaattacctgtggcacaaacacaatttttatttcatcatttgccggttcattatatttgcattttaccgtgcaatcctcaatctctccccacaaagacagttcctgcaaacatgtaattccttcaaaaaaagaagcatttacgtgataactgccttttatctgcgatatattttccacaaaaaaccaatcacgctgttttgcttttaatttttcccacattgatgtctgcagtgtcacataacgatgcgtcttttgattgtcagcacatgcactttccgctataatcggcagatcaatggtcataggacacaattttttttggaacagcaacagttcgtacacagaatcatttgccagatcttccggtgtcatccaaaatcgaaacgccgcatatgcacgctgcttattccaaaaatcatttatagcctgcggaaacagttcttcatgttccggataaaacttcttaaacgcattcctttttgtaacattgtcactatatttttcccagaaagaccggtcacattccaatgtcagaggcgtcacatctgccccccagcttgaaagcataacataatgataaaataaattgtcaccacgtatcataacatcgtcaaataacaggatctgccggttttcaaataacaatttaacagccgtcgggttcttatcatctggtacaatcccatccagtatttttgtcatataccggtcactgtagatttcaaattctccaaacacatgcaatggatcattctctgcaagttcccatttgtgttcttcatattcatcaaagagcatacgaaacagccaataaccttttcgggtaatggaaacgagtattggaagattcgtatgatctttatccttttccttatttcttttgatatattcattcagcaattttaaaattgcgtttcttatttttggattcaattttactaccacacagatgttttatttttagtatatgctgccaacacttcattcataccataaatagggaaccccaaaagagttccctattatcatggtttttataaaattactgtaacagagaaagtacaccctgattagactgatttgcctgtgcaagcatagactgtccagcctgtgcaagaatgttgttcttgctgtagtttaccatctcttttgccatatctgtatcacggatacgagactcagcagaagatgtattctcggaaatgttatccaggttgtcgatggtgtgctctaatctgttctgtacagcaccgagtgcggatctctgggaagataccttagagattgcatcggaaatagcgtcgattgcgtaggttgctgctgtaccgttcttgtcagttacgtttaagcccttgattccaaggtttgcagaattcatggtgtcgatgtcgacagtgatcttgttagtcatgtcagcatctgcacctacatgaaggctaaagcttaatgtgtttgcaacttttgcagaacctgtctgaattttgaatgtgccagtaccatttgtaagatctacaggcgtatttacagcacctacccctaccttagcagttccttcagtatcaccaatctggttagcagctaaaagctcttttgcagctaactcataagcttttgcctttgtgataacggaagtgtcattatcgtcaataccatcgtcagcagttccaccttttgcaccatcatctttgataagtgtaacggtctttgttccaactgtgattttagaacctgctggagcgttggctgctaaatcatcagcggaagctgtagctttgccaccaacacttgttgctgtagctgcggcctgatctttcaaagtagatggatcttctgaataataaccagcagtaattcttttaccatcctgtgtacttacgtcatccttataccacttgtaagtagttccattaatttcaatatcctgatgttttgtaccaatatctaagccgttagtaccaaatgcagatttaacatcatcagcagtgccaccaatagtatagttctttccaccaatgctgacagtatctcctgcattcagttcatccataacaaatgtagcagttccgtcaccattatcagtcaaagttccctttaatccggcatcatgtgctttcatattgacagtcttctcaccatcatcaccctttaacaggtaaatctcattgaatttggttgtctctgcaacacggtcgatctctgtatttaactggtcaatctcatcctgaatagccttacggtctgtatccttggagtttgtaccgtttgctgcctgaactgcaagctcattcatacgctgtaacatgctgtgaacttctgttaaagcaccttcagcagtctgtacagatgatacaccatcctgtgcattggaagaagccttgtccaatccacggatctgctttctcatcttctcggaaatggtaagtcctgctgcatcatctgctgcacggttgatcttgtaaccggaagataacttctcggttgacttagcctgtgctccggatgtgataccaagcattctgtttgcgtttgctgcctgcatgttgtgttgtactaccatactcataattgaatcctccttgaactcccgctatgcggggtattatgtcttttcctccagaaatccttttcctgaggttgtttcttattgcaccacgtctgcggtgcgtcacaagcatctgagatgctttgcaaccttgtatattctgccgtacaccttacgatataccgcaataagcgaagcgtcccgggtgtgccccgcttattaccaaatgtttgtgtaatgctaagcgttaaatttatcttttaaactctctgcatctttttttgcttctgccttcatccgctcattccacagaattcgtttaatctcctgctgtgcctccctggaaatgcccggctctgcataataggtttctctctttcgtgccggattttcttccgtggtacttctggcaatgttgagttcccgtggggcatcaatgagcagccttgcgtgatttcccgaaccacctacatagaccacacggatgttatcaccaatgtttacatattgcccctgtttcaatgaaagtttcagcattttgttacctccatgtatgtattccataccctgtttcctcgggtatgtcctgcgcattttcttacgcatctgcatttttataaaatgcttcttttctttttatttcaaaaatgcgacaatgttttatagaatgttgcattttatgtcacaaaagcactttatttttggcttgaaaggagtaatttttatgggaacaacacaaccgatccgaaaccgacaggaactgcagaatttcagctcatactacaagcaggtaaaaccgcatctgcgaaattatactttagttgtattgggattaaacactgcactgagaatcagcgatctattaaatcttcgctggagaagtgtctatgattttaaaaagaactgttttcgggatcatcttttggtatgggaacataaaacaggaaaaagaaattatattgcgataaaccagaacgcgaaaaatgccctgtatctatattttatggaaaagaatcccgatccggaggaatatgttttctccaaacggacaaacccttataaaccgctcagccgttcacaggcttaccgcattattaaagaagatgcctcacatacaaccagtgaagaggcgatcagctgtcattctctccggaaaacctttggctattatgcatggcaggaaggagtccagccagcacttttaatgaatgtttttaaccattcttcgtttcatatcacgaaacgttaccttggaattgaacaagacgaaaaggatcttgtctatctgaatattaatctgtaaaacgttcggggaatgctttgttgcgataccatgtacaaagcgttcaacaaagcgttctctttcataaaatgtttgactttaatcataaaatgcgttattctgttttcaataaatatctatattccaaatctgatgccaggccgttgttaccaaaaaggcagcacgtagcaatcatggggagcatttcgctcatatatcacaattggaattaaaatttcataaacgtgtcatagcagaactgtttcttattatttcatattgtaaaaacagacgtttatgatatatactaaaagaaaggcaggataccacatggagaaatctgacattctgacagcttcactgccagatgccaacgatgaaacagccgatcacagcaccatttttgatgatgttttccgaacaattgctcagaaaatgccacagcttctgattcctctgatcaatgaagtattccacacttcttacagtgaagaagaacattttgaacagctgcggaacgaacattatgaaaaatatggcactgtgattacagattctattatccggattggcaatcacatttatcatctggaatgccagtcctcgaaagacaaaacgatggttatacgaatgttcgagtatgatatttcgattgcgattgagcacgcttcttatgaaaatgacgaaatctgggaaattgaatttccacagtcctgcgttctctatatccgtaaccaccgcgatttcccggactatcacgaagcggtcgtgaagtttgcggatggacaaaaagtgcgctaccgtgttccaattttacaggcaaaaaagtataccgttgaccgcatttttgagaaacggctactgattttgctaccgtatcatattttacggtatgagcactttttgaagcacaacgggacggataccagaaagttacaacaattgttagctgatttccgtgaaattaaccgaagacttgaagaaacagctgaaaaagaaaataaatcacatctttatatggatatgattgttctgattgaacagattgcagattatatcattccaaaaaacaataccattaggaaaggattgggtgatgttatgggtggcaagattttaaaattacggtcggaggaattgctggaactaggcgaagctcgtggcgaagcccgtggggaagctcgtggaaaagcaaaaggcagacttgaaggcaaacgcgaagaaagactcgatgcaattcaaaatatgatggatcttggattgacaaaagaacaaattttaagaaaatattctctggaggaatatgaggcagcattgcgttctatgccagcaaaagtataaccgaaaagaaaatttaaaatattttcttttcaggggttaaggaatgcttccatcgtccgatatattatgtgtaaataaaaatgcaacattctataaaagaatgttgcatttttatttctatattttactcaaacacgatcctatttatactacttactttttatggtatcttcaaacgctttccgcacatcatcattatggcttgtgataataaggactgcatactgccctttcgtaaaaaccaacccatcctgaatccggctgacctgcttcggttcataggactgcagcaaattataccgatcctgctgatgctttgtcaggctttcttttgcctcatccacatctgccttatctttcacggcaatcactacaatttcatctgctttgtgtccatccgaagaatagcttacaaaataactgtccacttttttatagtccatgtcagaaatatgggaaaacttatcttctgcatctttttctgcgctgctggcattgagcatctccggcagatccggatccgctgcttccatcgccgtgcgcaggtcatacatactgacagaaccggaagtgtttttcttcgcaccacatcccacacacattaccagcatggtcagcaccagcagaagtttccaacccgttttttgttttttcatctgttatctggcctccacagtttcttccgtactgaacgttgccccattttgtgccgcattatccatggtcatatccttatttccgatatcagcacttgcgccatccatcatcatgccatctccgtttgcaggttccagtccctgaaatgctttctggacagccttgtcgatttttttctgttctttttcgctgatattctggcttgtattgtccgtgttatatcccggcatggcaacattaaacaaatatccttttccatccggatcctgaatccagttgtaagttcccagactgtatggcatatccttatagtttccggacatcaggaaattgtcaatggaagaagctatggcatttgccacctgcgctttttcctctgtaatatcctctttaaacgcaaccatgaccccgccaagctttttgtccatagcagcacgcaatgctttcggcagatcatatatactgtccacggttttcttattctggtatgccatattgtactttaatgagttagctgccgggaagtaatcgcgatcccagctctgggactgtccatacatggcatccgtcacattaaagttcgcataatttccatttcctgcatcggaataaatatcggtaatgtaccagtctccgtcaatttttaccacatcccagctatggaatttttctgtattatgttccactttacattcaattcccatcatctgcatgaacatgcggaatgtcgttgcataaccgacgcatacagcattgtggtattttaacacaccgtatggattatcacagtcttcctgtgtactcggaataacggtcagtgccccggaatcctgctggagctttttggtcatccagtcatacaccgccttttccttttcaaaatcagacatgctgtccgtaatcttcatatctttgatcgctttttttgccatatcaagggtttctttttctttgtctgtcagctttgaagtatcgccggatttgtaggcatccgaaatatttgtggtaggtttgatctcataattatctgcgatctttacgtaatcctcggtagtctcaggattttcttcctttttctgctctgcaatataggattttaaagtcaccagattaaacgcagaaatcgtggtacttcccacaacgcctgctgcaagaatcaccgctacaatccctttccatgcaccgccttttttcttttctttctgctccggctgcaccggattactttttacgctttcataagtttccatatgtatttacctcatattttaattgatgtatttttctactgcacctttattatagcagtttcatatccaaaaaaggctatctttaaagaaacttaaataaatattaagatccgtctgtacgaaaaaaggacatccaccgcgaatgtccttttctcccatatggtatcatccttatattacatcttcctcaatatgctccctgccctgtgcaatgattgaccggacgtggtcatctgccagggaataaaaaacagattttccctccctgcggcatttgactaacttattctgttttaaaatccgaagctggtgggaaattgcagactgtgtcattgacaatgccgctgcaagatcacagacacacacctctgcttcaaacaggacaaacaggatgcggatacgggtggaatctccaaacactttaaataattctgcaagatcatacagttccgtttcttccggcatcgtgtcattcacgatctttagcagatccggatgtacctgattttcactacagcattcaatcttttctttttccatgaagttcctcctctccaccggaacatttccggcagaattataccctataatttttttacaaaaagtgcgcggattgcattcagcacagcaatcaccataacaccgacatctgcaaaaattcccatccacatatttgcaatacctatcgttactaaaaacaggcagagcagtttaatcccgattgcaaaacagatattttcatatacaatccgcaggcactttcttgcgatacggattgctttcgcaatcttgagcggatcatcatccatcagtaccacatctgctgcctcaatcgccgcatccgatccaagtgctcccatagcgattccaacatcaacacgggaaagcacaggtgcatcattgatgccatccccgacaaaggcaacggtactcttttcttccctggtccgcaacagtttttccacttcggaaactttatctgccggaagcagctgggaatgtacttccgtgattccaacctcccctgctacctgctgtgctacacggtcatcatcacccgtcagcattaccagccggtgcacaccggaatttttcagtgcctgcatggcagccgccgcattcggcttaatcatatctgaaatcagtatatgaccggcataggcaccatcgactgccagatgcacgattgtaccggtacagctgcagttgcggtacgcaattttttcttttttcatgagtttgtcatttcctgctgcaaccctgtgtccgtctaccgtcgcgatcacaccgtgtccaccgatttcctgtacatctgtgacccggtccacatccagtttcctgccataggctttctgcaggctgatactgatcggatgtgtgctgtgacactctgccagtgccgcatactccagcagctgttcttcctttttcgtatataccggatgtccggacacaaccggacagctgccggatgcacagtttgttccatgaattccgcagacttcaaataccccctgcgtaattgttcctgtcttatcaaagacaaccgtgcgcgttcccgcaagtgcttccagatagttggaaccctttaccagaacaccctctgcactggcacctccgattcctgcaaaaaagctgagtggaatactgatgaccagcgcacacgggcagctgataaccagaaatgtcagtgcacggtaaatccagatgccccagtctgccggaagccccataaacagcatgcggacaagcggtggcagaattgccagtgccagcgcgccgtaacagactgccggtgtataataatgtgcaaatctggaaataaaattctcggaacgtgatttcttggaacttgcattctccaccagatcaagaatcttagaaaccgtagactctccaaactcttttgtggtgcggatctttaacagtccggaaatattgatacatccactgatgatttcctctcccacagcgacttcccttggaacactctctcccgtcagtgcactggtattcagggaagaatgtccttccacaaccacaccatcgattggaactttttcgcccggctgtacaataatcaccgtgccgatctccacctcatccggatctactttttcaatctgaccgtctgtttcaatatttgcataatccggccggatatccatcagatcactgatattccggcggctcttaccgactgcataactctggaacagctctccgatctgataaaacagcataactgcaacgccctctttgtaatcaccgagggcgatcgctccgatggttgccactgccatcagaaaattttcatcaaacatctgcctgttacagattcccttccaggctttccgcagaatatcataaccgatcacaaaatacggaaccagatagaaaagaaactccagccactttggtatggaaacaacgcttcctgcaatcccgatgataaccagaagcactgctgccacaataattcgtttcaatacttttttctgctttttattcatggtgccctccaatctgactgatacctatggaaaaagccggatttaaagaaagatctcacaatcatcttccactttcttacagttctttaacacatcctgcataaccgcttttgcatctgcaccctcttcaaattctacgttcatcttcagtgtcatgaaatttacagttgcatcctttactccggtagtagcttttgcagcttcctccattttatttgcacagtttgcacaatccacatcaattttgtaagttttcttcatcgtcggtttcctccatactttccttttttattttatcattctttcatatgagcatttgttcatatgtttgattctattatagcgtaaagttcgtaaatgtcaatatatttttaatacgctgggattgtttcggaattgaattttccagaccattttttaacaaacagatttgcatgtgttttttaaaaaaatcaagtattctatcactttccaaattgatagtggacatatagaaaataaaagattgattatgtcccacttgcatcgtgtgttgggacatatatgatatatttttccaactatgtcccacttatcaccgccatcgggacatattcatatactttcttgatatatgtccctcatctctattcttttgggacatatcacatacttttttcacatatgtcccactttcttttaggttcgggacatatctcataacttttttcacatatgtcccatttaaacatcttccccgtattcaccgtctgtttccggttcttcataatcatctgagccatcataaatgtcctgcatcaatggttcttttactatctttttctttccgataagcactgccgctacggctgcggcaatcggtacggtcagcacaaccccaagagttcccgaaagtccctgcatgatttctgttccgattacataagaattgatcagctgattataactcagattgtatgcataattgacaacgagcgtagacaacgaaccaccgacataggcaaaaatcagtgtatttgccatggttcccatcatatcgcgccccacacggattcccgacacaaacaactcttttgtccccagctgcggactgcgttcgtgcagttcctgaatcgtggatgcaattgacatgccaacatccatggttgccccaagtgcggctataatgattcccgaaaacagaagctgtcctatttttatctgtgtattctgtgccacataattcaacgtttcgatatcagacacattatacccggtaatgcctgcggcttttccaaacacaactgcggctgcggctgccacaaccacaccgctgaccgttcccaccactgcagataccgtctttttagagactccgcccaaaagccacagggtcagcaatgtcgagagaatgacaacaacaatggtaataccgatcggtgaaatgccccggtacatcagcggaaacatcagataaacaatacacacaccagtaaatgccagacttgcaatggctttgactccttttttcccacctatcatacatatcaccagacagaaaaaaagtacaaacagataaattgccatagtacggtctttgctgtataccgtaacgacagcattatcatctgtggaactgacaatgacaattacgcgcgaaccaacttcacagttctccatgccaaacaaggaaccgcttggattgacggcatcaagctcttcccctgcatatgctccggatttaacctgtacgcgcacctcctgtgtcccgtatcggtttccatcttctgccagattatctttcgtgatctttgtcacgactgctttctcatagctttgcccttccgtggaaatcagggatactttttcgaactggtttcctttgactaataacagtaggaaccccaccagacaaagggttcccactaaaacttttttccagtttttcttcattattatttagctgctttctttactgctttctttgtaacagtaatcgtaattgtttttcctgctgcctgatactggctggttgctgctgccttcaccgtaattgtaacctttccggccttttttacggtaacttttccgttcttatcaatagttgcaatctttttgtcggaagaggtataggtaagcggtgtttttgcttttgcatttaaggaaaaggctttgtctcctacggtttttttgtaagagttcttcgcctgaatggtctgctttaccgcatcttttacgatcgtatatgtagtagatccctgtaactgttttctggtcgttgcatcataagttgttacagaaaactttttgtccgttacttttacgacggaataggttggtgtccaggtctggcttctctcagaaatgaagtcctgtttggaagcaatcaggctatagaattttgaacctgttgcagagtttgcctctaaatatacggttccttccggattggtaacggttccgccaacggtcttgtttacgatttcatagcagttattctgtgcctgataatcactgtctttttcagcttcctctacagatttgtatccataagtgctgtaagaagtatgatcctttccatccccctcaagctggaaggttctggaataggtatgatcatgtccctgcatcaccacatcaatcttatacttatccatcagtggagtaagctgtgtacgaagcaccataccatcggaatcggaatggtcgtaaccactgccataaatatcctgatggaataccacaatacgccatttggcatctttattctcattgattgcttttttcatgacattctcatgcgttgcacagttatagttgtttgtatcaagaacaatgaacaggacatttccataacgataatagtaatcggttcctgcctttgtctttccctgtacataattggtatcggtatcggaaaaagcatttggattattaaaatgcaggctgtactgattcgaaacactgtcgtggttaccaatggtcgttgctaccggaagggaagtcagtgcctctgccccaagatatcctgcatattcccgctcgttgcttccgtagttcacctgatctcctgcggacacaagaaaacttacatcggaatgatcctcgagtgcttcatttaatacgttgttccagttatagctgtcatttcttgctgcaagatttttttccggtgcagaagttacaacatttcctgcattttccatcttttcactctcactactggtctgacctttcgaagcaccgatctgtggatccccgacatacaggaaagaaaattcatcaaacgcctgtgtggtatagttttgtgtatcctgccactttccatcctgaaatacctgataataatagctggtattttctttgagcccgcttacggttactttattggaaaaatattttgtggtatctatggtcacagcttcggtctgcgctccggtgaactctgtcgcaccatccatattctgtctggtagagattctcacctttggagtctcagccgttttgctgtaccatgcataatttaattttgtctcatccgcacccggagtcagcgatacatgttcatactggctgctgtaagcagcccagttctttttccagttgctccagtccgtagactcctgggaagcatcgttccaatgttccgttgctgctgcaatctttgtcggaactccggtcgcaaacatgccggccaatacggcggaagagaggactccggctgtaatcttcatgacattttttttcataattttgttctccttgtgaaatctgtaagatttattacaggatttatgataaacaggttatgtaagatgtactatccggtttctgtaagtcttaggtaaaaagaaaaagagtggatgctttgggacatccactccacatgccggctatgccatgccgtttacggttttatatttatagagcatctccgcgtggttttgttcttccacctggatatctgccagaagtttgcgcacatcagaatccccgaatgcaaacacatcggtattatacgttccggacaccattttttcagaaccaatgctgtctgtggcaaggaaattatcgtttttcttatcttccggattggtcatggaatcatatgttgcctttggctcatacatctttccatccctgtcattgacgttacaggatgggacgctgcctttcatgacctgttccagagactccacatgcttttgctctttcttttcaagatcagcgaataaatcccgaagcaccgggtcctttgcttcctgtccgtaacgtttgtacttctccacgcaggaaagttcctgtgtgtgcagatcctcaattgtagccatctctttttctgttaaaaccatggtttatacctctttctttccataagataatcttgttgattgcagaacatgaacactccgcaaccttctcctctagtatctgtaaaaaaatgcaacacatacctggtaaaatttcgtcaaaaagggttgaaacttctcacaacagattgtataatttcgtttgtattttatacaatgtttacaaaaaggtggattattttatggaagaacgagaaaaattaaaatcccgtctgggattcattctcctgtcagccggatgtgcgatcggaatcggaaacgtatggaaatttccatacactgccggacagggcggaggcggtgcctttgtgctgttttatctgttgtttctgattattctcggactcccgatcatgacgatggaatttgcggttgggcgtgccagccagaaaagtccggtcaaagcctaccaggcactggaaaaacccggacagaaatggcatatccacgggattatcacattgatcggctgctatcttcttatgatgttttatacaacggtcaccggctggatgcttcattatttttatatgacggtcaccggacagtttcagggactggatgccgacggtgtatccggacagtttaccacaatgctgagcaaacctctgaccatgggcttctggatggtggtagttgtttgcgccggcgtatttgtctgctcccgtggactgcagaacggtctggaaaaagtaacaaaggtcatgatgacttctttgcttatcatcatgatcattctggcggtcaacagcttttttatggatggggcaaaagaaggccttgccttttatctgatcccggactttgaacggatgaaacagatcggtattgcaaaaaccattacgggtgccatgaaccaggcatttttcacgttaagccttggaatcggcgcgatggcaattttaggaagctatatcggaaaggaacgctctctgcttggtgaatcggtaaatattgccattctggatacgtttgttgctatcacctccggacttatcatttttccggcatgctttacgttccatgttgaccagacttccggaccaagcctgatttttatcaccctgccgaatatttttaaccatattccgcttggcagactctggggaagcctgttctttttgtttatgttttttgcagcgttttccacaatcctggcagtatttgagaacatcatctcctgcggtatggaactgaccggatgcagccgccagaaatcctgtgccgttaatctggtactgatcattgtactctccctgccatgtgtactcggatacaatgtatggaactggaaaggtttttcaatctttggcgggtctgtgcttgacctggaagattttctggtaagcaacctgttcctgcctctcggttccctggtatatctgctgttttgcacaagccgctacggctggggctggaaaaactacacaaccgaagccaataccggaaaaggattaaaaattaaaaactggatgcgcggctacattacctatattctgccgctgattgtgctttttatctttggatttggcatttatgataaattttttacaaactaaggaggatttcttatgtatcacgcaaatgaatcacgttacgaaaccatgaaataccaccgctgcggcgacagcggactgatgctgccggaagtatctttgggcttctggcacaatttcggagataccggtgtttatgaaaatatgagacagatgtgctttacggcatttgaccacgggatcacacattttgatctggcaaacaactatggaccgcagccgggcagtgcggaggaaaatctcgggaagatccttcgggaagaactttcttcctaccgcgatgaactgatcatcagttccaaagccggttttgacatgtggccggggccttatggaaactggggcagccgcaagtacctgattgccagccttgaccagagcttaaaacggctcggtctggactatgtagatattttctatcaccaccgcatggatccggatacgccgctggaagaaaccatgggtgcactcgaccagatcgtgcgaagcggaaaagcactgtatgtcggtctgtccaactacgatggagaaaccatgaaacgcgcagctgccatcttagaagatctgcactgcccgtttattatcaaccagaattcctacaatatctttaaccgtaccattgaagaaaacggtttaaaacaggccgcagcagatgggaagaaaggaattatttctttcagcccgctcgcacagggtatgctgaccgaccgttatctgcacggcattccaaaggacagccgtgtcaataccgacggacgttttctgcatgccgaccagttcgatgaaaagcggctgaacagtatccggagtctgaatgagattgcggctgcccgtggtgaaagcctcgcacagatggcactcaaatgggtcatccgtgacggtgtggtcacttccgttctgatcggagcttcccgcccggcacagattcttgaaaatctgaaagtgttaaactctgctccgtttacggaggaggaactggaaaaaattgatcagtgtgcactttctctctaggtaaaacaaaaaccccggatatttatttccggggttttgtcttttcctgcatctgctatttgactttgacttttaattttaaaactttggtcttcccattgtttaaggttactgtcacgcgaatggacgcagttccttttttgttcgattttatggtacccttcttgtttacagatgcaatttttttgttattgctctgataagaaatgctttttacattgtccatatttaaggtggctgccagagaaaccttcttttgttttcccttcttcacctgaacggttttattcttcaatgtaaccgtttttaatattttcgttgtgacctgatccatatctttctgatccataaggacgtaattcttattggaatctgctgaaaaattcacatttccggcttttgtaaccgtataactcttgtcgtttacaaggacataggcacctgtcttttgatcttttgcgcacacatacagcttgtttccggtctgtatgtctgctgtatttacggtcagtgtatagcttacgttgccagccggatcggtgacccggatcgtcacatctgtgtgttttccattattttcttccatggtttgttttatcagatcagcggtcaccgttgttttgatggctttatttttctgggttccggtaacggtcacggttggtgtattttgtccggccgcgtttccatcggacggtgtttgtgtaccagctgtatttccgttagacggtgttccccctccggttgtgtcaccacccgaagtatttccgccaccggaacttcctccggaagatgagccacctccggtcgttccacttcctccggaagatgagccgcctccggtggatgagccgcctccggttgttccatcgcctccggaagatgagccgcctccggttgttccacttcctccggtggaactgtcctctttgattgtaacggtcacggcttcacttgtcactgtttcgtaataagtccgtccatccttatcatccggctcatatactgccttaaactgataagaaccgccacgttttaagcctgatacaaccgtatcggcttccccatatacgagtttttcctgtgcctttattatggttccgtcctgataaaaagaaatcgaaccaagcggaatactaccatttcggactccatctacctgtgcatacagatgtacggaattaccgttttctgtctctgccgtaaggcgaatcgatggtttcgccgctgtaatggtaaaggttccgactttttcctctatcacatcgtactggtttccagttactttaaaccacacctcatagctgcccggctgcaccggaacaacatttttcccatcctgccgatagaaaacttcaggctttacctgcgaatctaccgtctttccgttgtccgttcggactatatttaccgtggaaacaaaacagttctgtttcagccctgtgtacgcaactgtctgctggatggtatcatactgcatctttacggcaattggatttaccgtcacggtttcgtttgcctgggaaggaagtgccctgtagttttcattggctgctcctgcataagaaactgtaattgcattttctcccatatgaaatccgtttgcctctgaaaccggaatctttatggctgccactccgttttgaagcgtgatgccggatacttcataaggggtctggttaatgtataccgaaaaaccagcagatggcacgtgtccctgtaagctgctatctgtatagaccgtctgcacggtaagattcagttcatcctgcatggacacggccgttggtaatccatttatcgtagtggttgtttcctttgaagtagccgtcgaaccggatgtatccggatctttgtttacaatcagaactaccttctgctcaatttgttcatctgctgaaaatggacggattgtgatgtagtaggttcccggttctggcagtttcagttcgccactagtagcatcttcataaaattccggtgtaattgtatgtaccccgtcctgatttgtctccggatgaaatgccagtctaagatccgaaacattggcatttccatcatcaccaaccgttgaataatatatatgattattgaactctacttcgtatgtaagtggaacctgatataaagttttcccattttcgggtgtcccttcctgccattccacatccagataatacgatttatcactactcataatatttgaaacattcgccaaaagtacaggattttttactgtaacattttttaccgcaaccggtttatcccctgacaactcactggttttccagatttctccgtttccagacgatgtccgttccagtgtcattcccgcctgtccgtctgtcggtgtaaaagaaaccgccgtatccgcagcccttccaagttccagataggtgtgaccatactccgcaattccggattttccatttcttccattcagggtttcaaatgtaagtgcacccgtaatggtatctgtaacattcagcttctgttcttttcctaagatcagtcggtttcctgctgaatccgcactcacaatcgaatgtacctgtggagtttccatctgggaaagatcaatcgcacttgccccttccagcctgaccgtacagctgtccaacgctgccggtgcaaatgttccaccgccctttactgtgaggtttcctactttgcttatacctggaattccggtataggactggtcggtatctatggtcagaaatgtcttccctgcgtgattttcagatactccgtacacctgtttcgtatcggaaccggtaagtgaaatttccacatcgccggaaaccgtatattgtccatccgctgccggtggatccggctcctgcgtggaaaaccagtcatcctgatttacatatggttcaatggcaccggatgcatagatttccccattttgcgtaccggaaacgtgcgcaagcacgatctgtgtcttaccgtcatatgttccgttcatggaaccggcataaatattccccagattggtaccaccacccgtaatcagaatctgtgcctctgatcccggatgattccccatattctttccattctcataaagggatccgccaaagatatctacatagcggaatccgctgtcgcacgtaacattctcaagaacaagtttatgcccatttgcaaaaattgcatcgtgcagacgattggaaaaccgcagcgtaatgtttttaaatgtcacatccgtattcaggataaatccccccttacggttggaaaaagtatttccatttccgttgacggtcacgcttttatcaaaaataaacggttccgcagcctcggcatttaaaaaagcaccacttcccaaaattgagatttcatccccattgccggcagccgcataggcatcctcaattaaattgtagggatttccatagcttccatctccggaatgggtagaatttccatctttaaattccgtatagatcgttcttgccgctgtctgcacagcctcctgcgcctttaccggcacgacaggctgcacggtaatacacatggtgagcacgataaaaaatgcccatagacgttttgctacattgtctggtttcatttgcttgttctttttcatccatttctcctgataatcagaacagggggatgagtcaaaaactcattcccctgtcacttcattgatagtctctgccatcatcctaacatggtttcctgtcagcgtcaacaaatttatgacctgtttttatacctatatcatctgctgattttatattttattatttctatctgttctatctgtgtgatatcaatcttctgattgaaaatataacgagccccacaatatttcatttcacttgcagatgcatagccatctccaagctcttcaagatctgtaccatccatgaaaggatgtttctttttttcagttccttttctgtcatcggtaagaggtaactctcctatggaatattgctttccgtcttttgttgttgcaactacatgataaaaacaccctttttctctccagtcattgacgggacaaatactaaccgtataaggtgtaatttcaacagggattgttttttttgttttcttaacatccgcttttaacatcttctccttcattggaacaacttttcccttaaccaaaacattttttaatggcgtatttgaattatccggtgattgaaatcccttatatactttcggatttttccacgcagtatcatcggaataaaagccgcatacattgatctgaataccatcacctgtatctattacatccaccttactggtagtatctaacccacctaaccaataatttgttccttccaaatattttacgttcggaaggaacacctttgcacgcataaccttcgtatttgaagcaacctgaattgatgatatgattatcttttgttcttttctgccatcatcttctctactgtttgattttgcatcagaattttttccacacgcacacagacaatatagcattgtaaaaattaataagtacagactgattttcttcattcataatcctccaatttctttttctttaaaacactaaggattaatatgcttcctatcactataattccaatgccagccacatatttcatcgaacttctgctctgtactccagctcctgtacttacctcagaatcttcaatataagtatctgaaatctccgctacagaatcaaatgaatagacaccgctttccacattttgagtttccggaattttctccataaccggatactgataccccaacgaaatccagatacgtgctgtttcatcatccatcccaagtgcaaccggctgtctcattcccggttgacttcccaccagtactactctcgtacagtccgataatgcctctcgtttttccagaagtatatcatagtaaggttccactgtatgttctgctgtctctgtaatcatccattttccagcatgattttttacttcttcctgttctgcttttgtcaatacagactttgcttcttcactcaaaggaagtcctttggctacggtaaacattccatatgtcttttccattttaaaaggaatgacccatacataatttgcactttccagagcacttgtgagttttttcgtatctgccgtctgcaattttataagattacaatccacatatacttttaatgccttgtcataatcgatggttgcatccggctcttcttttttcatttcatcctgtaaattactgatttctgtccaatcacggctcgttattaactgatcctgatctgaaaccggtatttccgcggcatacacagcagaacctgttatcgtataaattgtaatcatcataagcattatttttaaaatatttttcatggctatttcccctctcttgtgtatactatacttcatttttcccattattctttctgcatgttaaaattggtttgattttcgtcaaaatctgcattaaaaatcccatagcatacaccatgggattttttcaaagatataacacaatctgaacctcaaatatattttcatcgatatttatagatttccatcccccgtatttgtctacaacatctgaaatattctgcataccgattccatgcaatgcctgttgtttcttccttgtcagtaaacgttctccctgtttattgacttttccatcaaacgtatttttcacctgtatacccagaatttccctgtcgtattgtatccgaatctccaaaaaacgatcttttatctgctccattgcctcaattgcattgtccaacagatttccaaacaaaacattccagtcatatccatccactggcaactggcacggaatcacaatctgcgactgaatctgacaggacattgcctccgcttttgccagtttatgattcaaaatcatatccaattccagattccccgtattcacatacttatgctccgtctgcaaatgctcactcattttatttacatattcctgtgccttatcataccttccttcattaagatatgtctgcagaagatacatatggtttttcatgtcatgccgcaaagaatccagctttttctgattctgctgcatgatatgcatctgctcctgataggccatcatatgtttctttaaaagccgttgctgcattttatcctgataagcttctcccaaacggtcatacaaatagaacattccaagatctacaacgatcataatagccagtgataatactgtttttggcgaattttcgccggatacactctcaagagcatatatccagacaatatttccggctaatacaagaatcataaagtaatagttctgtgtttccataacccttcgccgacatatcacctgtcttattcccattgctatgagcagattgaccattgcccctgtgatggttcccattgcccgcccttcggaaaacaaagaaaaatctcccagataataatacatgataaattctatggtaagccccagcaatactgtaaaacaacctgccattattttctgtagtatacttccttcatacaatataccttctgccgcccagagaagcaataccatactcaccgtagttcccatggcatttcgaaaaccaaatgcaacaactgtattaataagccatacgatcacataaacaatatttgccatccgtggcagttttcttttcttttccagaaaaacatccgtcactttaaaacttacatacacacttaatatgttacataccgcttcaaatattctttctatgttattcacccgccacacctcatcttttccacaattgcatgatcaaggttatttttcatagaccgactgaccggaatgtcatccccattgatcatgtgtacgctgtctttctgaaaagattctgcataccgcagattaatgacataagatttatgtaccacacagaataaatgcggattcaacgcaggaataacctccgaaagttttccataaacacataatgtatcatttgctgttaccacttgaatttttctggcaaggctctgcaaataaaaaacagaatgttcttctatccgtatcgaatttcttcctttcccaatttctataatatgtggctgaaactgatacagcctttcatattcatctaatatataatctactcgttcctgttgtatgggtttcacgaggaaattcattggacgcagatcaaaaagctgcatggcatacatttcttttgccgatacaaaaacaatctgcatggattcatattggatctgggatcgaatccagtttccaacgataatccccgagctgtcccctaattcaatatccaaaaataacaaatcatacctttcgctttgctgcagtttttgaataaattctgctccacttgtataaccgtcaacatccacttttattcttttcatttctgcaaaccgaaaaatactttgttccaatttataaataaattgtatatcatcatcacatattgctacttttatcattgtatatcctgtaatttattttcctctctatttcaggatttcctgcagccgcgcatctgtatgcaggagttccttcgcgcgatccctatattgctgctcatgcagatacgtatagcggaacggtttgatcgacggtgccagatcaactgctttctcaaaatcctcccgccgaagatccagtgtttttacataatcccagaaccccgtctgcataaaaattgtgtctaccctccggtaacgatgatcctgcacaacactcatcagataggttgcaatgccaacctgaataccatgaagctgcggatgctcaagcatcttgtccagcgcatgggaaatcagatgttcgctgccgctcgttggcgcactgctgcccgcaatctcatttgcaattccgctcattgcaagagaatccagaagttcctttaaaaacagatcatcctgtatcgaagtaaacggtgtgcgcacaaaactgttgactgctttctttgcaatcatgacagcaaaatcattgacttttccgtacccatgttcttcctcaaaaatccagtcatacagtgccgtaatttttgataccatatcgccgattccggaatataaaaatttctccggtgcactgcggataatccttgtatccaccacaatcccatatgcaagttttgccggaacggacttgcggcgtccttccaccagaagggaagcactggcacttgaaaagccatcgctcgatgccgatgtcgggatgctgataaacggcagatttcgcagaaatccacaatatttcgcaccatcaatcacttttccgccaccgatgccgatgactgcctgcgtcttcgccggcatggaaaatgcaagactggtcagatcttccaaccgcacggtatcaagttcctgatattctaaaatatcaatgtcctcctgctgcaatgcttccataacggtagaaccaaacatttctacaagaccgtttccaaacaatacaactactttctgtaactgtaactcttttaagtaaatccccagattgtccaatgcacccgcaccgatctttaaaagtgccggaatggaaatgtgttttcctgccataataaatgttctccttctcattctcttttctattgattttagtataaacaaaggttcctgaaattacaatcaattcccccgaaaaaacgcacacgcttctctttacaattatgggtaagaaaaaagacgatttcctgcgaaaccgtctttttcttattaaaattctgacgagactcctgtaaatttactttgtcactttgatcgtcatctttacagtctttgtctttccgttctttaaagtgacttttactttcacaactgctttgccagctttctttgcgacaattgtaccatttttattcactgttacaaccgcctttttggaagatgtataagtgatcttctttacattttccatgttcaggttcttatcaaaagtaacttttgccttctttccgtttgcaaccgttttcttggtatcctttaatgcaacactctttaagattttactgctcagagcctttgcatccttctcattcagcagtacataatcaccggcatctttggtatccactgtcaccgttccgtctttggaaaccttataagtcctgctgctgatcaggactttttctcctgtctttttatcaacttttacaagtgtcagctttttgcctgcctgcagatccttcgcattgacagatacgctgttcatctctttgccggaagcgttcttcgttgtctgggtaatcgtaatgtcgctggttcctgcctctttgactaattttgcaaccacatctgctgaaattgtagtcttctttgtctcggaagtattctttactgttttttccagctgtgcccgggcatctgtcacttctcccttatcgttcttttcaacggtaagtgtcgcatttgtatcttttgcaatattctcaaatgttttgtccgttttccgggtttctgatggttttgtatccggtgttgttgtgctgccggaatttccaccagaggtgctgctgccggaggaagaatttccgccattatttccactctggctggtctgttttaccgcaatcaggccatcggcatctgcttttgcagcttctgcatcactgatcgttgttcctttgaatgcatcaaagtaaagtaccgattccacatctaccgcggaacctgccgggttggaattacaccagagtccgaatgcctgcacatcttttaaagcatccccactaagttttccacccgtcttccctttaaaagcggagaatggaacggttacttcataggcatcttctgtcttcgcaagattggtcagatatacttcatactcttctcctcctgccttgatctgtacaacaaccttctgcccttttccatcaagttttgtccagaatttcaatgcattataggctgaaaaatctgtattgcccagacttgcatttaccagacccgtccagacttccgaaccggttgtttttaatttgtaatgaaatgcagcaccatatgtaccgtctgccttatgctcctgatccagcgtaaaggacgaactgcatccagcggcagaatttccaccgtaagctgcatccagaagtccattactcccgacatagtagtcaaaattttccagcacacctgccggagctttgtccttttcttttccgatactcagatttgtgatcgtggacagttcttttccatctgcaacaagtgtaatggatgctacatctgtttttccgatctgatccatttccttttgtgtcagctgcgccgtatagaatccgtcggagccttttgcagccggcaatgtcaactgtttgccctttgccgtatcctttacaacaaacgatacctcaccggcattggaaacacttgcctttaatgcagttggctttaaaatcgtatccatatcaaacggtgctaccatgtatccgctgacatctttgtatttctcggtctttactcctgcatacttatcgatattgccatagaaattagtaccgtttccaaatactgaatcctcattgttatagtaatcaataaactcattgatcatttcctgacccatggtatcactgtatttatacggcacatagaaattggtatcgctgaaatttgcccataccatataatatggcatgtcgtttttctttgcgatatcattcactttctgataccagttcacacccgactttgcctcactgaccggattattttttacaagaagcccttcgttatcacttccatccttcttcatcacacgtacaccggtctccgaaattgcagccagcttgttatgctgttttgcaagtgatgatacaacctgacaggtctgatccagatgatcaaagaacgacgtatctgcttcagccggataggtattaaaatcgttgtaatagtcaaatgccagaatatctacataggcatctcccggataacgcgacatatactctgcctcggtctccagcggtccgtttggtgaatacacataaagcatattatgtacccctttggattccagatactctctggtatatgcatacagactcttataactttccgccgtgtttccagttccccaccagaaccatccgccggtattctcatgcagtggacggaagatgaccggaatatttgattcctgtaatttattcgcataggttgcaatggtatccagataagccgtaaagaccttattcttttctccttctggcagaatcttctttaagctgtccccggacagatctttggattcgttgaaattacagtcaaagaaatcgtaggttccatccccattgtctttgatcttcgcgcttgtgaagtttggcatatgtgcagataatgtgacgattgctccattctctgctgcctttttgctgtaattgatggaattttccagtgcagattttgcatctgttccacctgcctcgcttccaaacagtgcaagggaatctattccaaaaataccgctgacagaaccggtcacatcatggacatctcctaactcatcctttgttccaaccgaacggctgacatcattctgatgaccaaacagtacctgatcgctctcggtcagtccctgtaaatatgcatacaatgcctttgcgctattgctggcatccggatctgtcatggtcagggttttatctgttgcttctggttttgcctgtgttccgtctgtattcggtgttgcggtaattgtcacaaaatcaccactggcatccttctgggaaagtatcagattatccagataaacatcccctgcaaaggaactgttggctccgataagtccgattgtcagatcatccattggtgtggcagatggagaaaatcctaaagtaactgtaactttcttatatccgtttcctgcatctgctgcctcggacgaatctatgctggtatctttattgatcccgctattggagaaaaattttatcttggaaatattactgctttccggataaatcaaatccacactcacctgattataattgctgatatcagccggtgtcttcggtgtgaatttcacttttgcctcactccatgattcgccggagttggctgtataattcaggcttacttttaatcttccgtctccgccatttgcgtcataggaaagttccggagcagcattttttgttccaccgtggaaatactgatatccggtttcacctacccacagatttacctgggattcatcatttaaatcagaaagaacggttggctcctgtttggtcagttcctgtttatcgcttgataaatttgtgagaactacatttgaaaatgtcacagttcccttaaatccggttcccacaagaacgaattcaacatccatcaatgtatccggtgttattcctgaaaactttactttcagatcagctgaataattctccccaactttcataaaagaatccttctgcagccactggcaatccgtactgttgttccatccccattttgatcccagttttgttacaccctggatattcagatgcgctttatctgcatccagcgactgataggatgtttcatccagtgttacctttgcagttaattcatactcttcattcacatttcccgacgagccattgatggaattatcatatgcaaaagtaatttttcctgcaccattccagtcttcttcttgcaatcctgaaaaatcaatggtttctgttgtttttgcgttctcatttttgtacagttctgtacgtgttactgttggtgctgacgcttcatttgtttccgccgcatacacaatctcattctgtaaaaatgtgcatgcctccggtgtcagtgaccccatcattgccgctgccagcgtgatggcaacaatctgttttcctacccttctcatgtttttgctctacctttcctttcttctccattttagttgtaaaaaccttccagcaccctccatctatccggtttcacttaataaaaaagcaattgcacgctgcttcccatatttcagggagagggtactgcatacttggggagtgcagtaaaaaatatgggaaccagtgtgcaattgcttaatttatttgataaattcagtatatcacaaagtaattttaagtcaatatttagttaatagaaaattaatcgtttgtaaagtattacttaatttaaagttttttagtctttttttagtcttttaattagacattttcacaagagacgaaagtaccagttccttattaattgaaaaaagcacctgtaaagcagattatgttctgctctacaggtgctgatatcgtgcaagttcttttaagctgccttccaaagaataaccccctctttttgtacattcttataaaatggaagcacttccccccactttttcatattttcttctttaatatcaatgatagaaaaaatcttatcataacgtaccattttttctgcacctattccatattttctttttaataaaattccaccagtcaaagaacaattcaaaaattaaggggacgatcaaaaccatccccttaaaaattttaaatataattaatcaatttttcttaacattgccaagtcaaggttacaccagtcatttgctcctgctacagaataaaccccgatctccaacgtatgatttgtaacaacaatcttgtctatactaaaaatattccaattaatgtcacttgtttcaatcgtggtatcaagctcacttcctccataattttttgcataaagttgtaaaacatcctgtttcccatttgtctttgcccaaattgagaatttatatgttccattcggaatatttgtatacgttttatatacagaacacgaatactctttatcatcccaaaatgttaatttgtaatctccatcatatgcatcaccatattctgttcttacagtattttcatctgacgaatcacttgtccatacattccatccactcggtgaagtagttatcccattctgttcaaaactgatatttgtcaataaattttcacacggtttattaagcaccttaatagaatctaatgcatttccctgaaaattaaacaacgtcatgttatcccatgtattacttggcgttacggtatcatttttatacgcaacccctgcagatgtagcatatgttccgccttctacaggtatccattctggttcccaataaaaatatccaatacctttgtcatctggtacatttaaaatgattgattccagatcattcataaattcaaattgtccttctactgttgcaggatatcctccaacttcttcatctccactaatgaatacatttccttcaccatcaccatcttccgttgtccatgcatacgcagtttctacaacacacacttctttattataggtggtcgccaagtaattcaaattatactgaagcccctccatggttccatgccacattggataataagataatccaaatacatcaaaatccaagtttggtgactctttcaataatccaccaaaataccaggtatacaactgattttttccaccctgatccagatgaagcataattttggtacttgatgcagcagaagcacgtactccagaaattgcagattctaaaagacccgctaatccggaaaaatcctcattcgtccctattttgccatcttcatgaagaatccccgatgatatttcattttatccttttacccctccggcaaccaatccattctgaataaatcgctgtaagcacataaagatgatcatgatcggcagggatgaaatcactgctgctgcagcaaacaaagtccagtgcgcagcaaactgatcgctgataaaagactgcagtccgagtgcaagcgtcatttttcccggtgtctgcaaaaagattgaggtaatcacatattcactgtatgttgcaataaacgaaaacaggaagatcacggcaagctgtggcattgcaagcgggatgatgatcttataaaaaacctggaattcatttgctccatccaccattgcagcttcatccaattccaccggaagtccatcgatataagatttaagtaaccagatattgtaagcacttccacctgcaagcacaagaatgagcgcaaagctgttgtccaccaacccgaacttataaattaaaatatagtatccggcaactgccatgctgtttggaaacacctgtaatatcaaaagtgccatcagtccatattttcttcccacaaaccgcagtcttgcaaacgcatacgctgcaagtgaagtaagcacaagttgtatgattgctacaataaagcaaaactttagggaattaaaaacccagattccaaaatccgtttcccgaaacagttccacataatgttcaatactgaatttttcagggaacaatgaggacaggaaaaagctgtcacccgcggaaaaagaggacataacaatccatatgaccggaaacagcaccacgatcattgtgatccatatgaccactctgcttccccacagtgtccgttgttctgaggcggatattttctttttatttttcatttaatcaacctccttaaatgagccggacagccgcatattaatcagcgtaaatgttccgacaatgataaagatcagcacactgaacgttgcagacagttcataccggttcgaccatgtggtcatcttataggtggtactggcaaggatatccgtataacccgcaaactggttatccactctcgctggtccaccttgtgtaatcatatatatatttccaaaattgttaaaattagccgcaaacgaggaaattacaagaggaatggaaagttttgtcaccatcggcaatgtaatgctcttaaagcactgaaattttgatgccccatccattttagccgcctcatagtattcaccagaaatcgcctgtagtccaccaagacagacattcatcatatagggaaatcccagccacacattcacgataatcaacccaacccttgcccagaatggattggtcagccacggtacattccaggcaataccgattgtatgcagtaaattattgattccaccatactgctcatttagcagtccctgccatgcgaggattgcaatcgtagatggcaatgcccacggaacaattagcactgcacggtaaatttttgattctttcatatgcggattgtttaacaaaatggcaagaatcagtcccattgcataggaacctgccgtacttaacagcgcaaaacaaatcgtccacccaagtaccgggaaaaacacatttttaatgcttccggaaaatacggtcagataattttccagacccacaaacgtgtaatctgtcagatgatacatgttgtaattagtaaaagataaaatcaccgtataaataattggcagacatgtcaccaacagaatcgagatcagtgccggtgccagataagtatacccaagcgcattctttttctttctcatgccatcactactttcctgaattcatcaattcaatcgcttctttcaactgcgtaaccatatttttggcagcttcctctggtgtttgctccccagaccacatcgaacggatattgtttgtgtggatactccagagctgtcccatttctgatacggtcggcatcggctctccatcattgatctgctcgacaaatgcctgtgtgtatgcattactctggatctcatcaagttcctgatctgccaattttgccggtatacggtcacccgcctcatacatgccaagtgcaccgttttccagcagataggaaataaaatcccatgctgcatcctgatttttactgctgttgctcacaaaacttacctgtgtacccaccggggtcacaaacggctgtccgtggaaagttggcatttttgctacagcaaatttagttcctgcagaggtaaaaccgtcaatgtcccatggtccaccaatataataagcacattttccgttttggaaattacttcttgcgatatcggctgtcacatctgccgtgatcagtttatatttattgcacaggtcattgataaaggcataggcatccacactgccctcattatcaagaccgatgtctgccgtgtcatatgccccatcctgatatttaaaaatataacctccgcaggctctcacaaaaccaagatcgtagtatatgcttgttgcatcaaactgtacacctccgtctgcggctgcctgatcgaccagttcttcccatgtttttgggacttccgatacaagatctgtgttgtaaaacagtgcagtagtctctacggaaagtggtgctgcatatcgttttccatctacataacatgcctggatggctgcatcggaaaaatcctgatccgcatacagatcctgtggcacttctgcagtaagatctgcgtttacataatctgcaagctggtcattgggaatacccaccacagcatccggtccggaagcactttttactgcctgtgcaaactgctggacagatggagactggtgaatgacttctacctttcgtccgttcttttctccccattcatctgcatatttctgaatggtatccacttccacgttcatgttcgtccaaatcacgagtttttccccggaagcttccttttttccggttccacttccacttccacagccagtcaacattcccactgccattgttacagccagcacagctgttattatttttttcatatgattatcctccctttacattgttttcatgtttatcagcgcgctgtttgcgtttccattttcgtcaaacaatgccatatttgccatggcatttcctgctgtcatcttgtctttcatgtacttgctgccactcttacttgcccacgtacagtccggtattggcagccatgccggttcccagtaaaacacaccgatgcctcttttattgtttacacttcttaccgttgcaaacaaatcccgcaagaatgcttcctgtccctgctgtgttgccgggtatccagtgattttttcatgctccttcgaataaacgattccgttacagccaaatgtttccgtggtataaccaattgaagtctctgcaacaagcacatctttgtcataccggctgctgatatcattcatattatccagaagaagtgaaagacttccgttccagtgcggataatacgacattccaataatatcaaaatccagcgcatacgatgaaacctgatcaaaccactgtcgatacattttattatccgttccgaaatccagatgcaatacgatccttgcatccggacactcctcgcgcacccccttaatccctgccttcagaagatgtgccatattttcggtctgttcgatgtaaccatccggccacaacagcccttttgtaatctcatttccaacctgcaccatagtcggcacaagcttgtggtttttcaatgcctttaacgtatctacagtatgcagatacaccgccgtttccagtgcctctccgcttaattctttccaggctttcggttttacctgtttggccgggtctgcccagaaatcactataatggaaatcaagcataaaatccataccgctttgtacagttctttctgcgatctcaatggtagtctccagatcatttccacctcccccgtaagaatttccgttttcatcgtagggatccggccaaatccgaatccttacgttattggttccgcatgtctttaaaattgcaaacagatcttcttttttcccgttcagccgataggacgcaccatattgttccagttctttcaccatggaaatatccatacccttaataaatttcataactactccttcacaagtgtaatatcatcaatggttccccagccgcccggtgctgttgccacgtgtgctcctactgtgattgctccgtccgttggtgtaatgcccgggatttccaccgtataccagttaacatacccctgcaatttgccatctgcttttacctcttcgccatccacgagcgcataaaaatatacggtcggattttcatccccggctgcatcaccctgaatatgagcggttagtttgtaggtgccatcctcaagtccactcactgtctgtttcatggaaaaatccaccggattgtttcctgaataaaaatgcagtgactgtgcacctgcaaaacagtctgtctcacgatcataaacatctaactcctctgtaacatcattgttgtttgtcaccgtccatccggaaaaatctggttcttcaaaacttccgttgatcagataatttccgttttcatctggcgtacctgttgtattttccttctgttctgcagcagcaacttctgtgcctctctcctcttcaatgttctctgtttctgtagctttttgtgttttctccgcatcagcattaataccagatgtgtttccacatcctgacaatgctactgccatgctcgctacaagaactgcatgtaataacttccttttcataaatgttcccccttttctaaaattaaatctttactaatattcaagtaaattatttacttattaagaatgtatcatctaagcataataatgtcaatactaacaaatacacttttcactatattgccaatttttatttttgtattttatgcaatatatacaaaaaaggcacaaaaaaagatgttcgcaatcgaacatcttttttcaacaactcttccggaaaactggaattccatttacaaacaccagcttggttacgcgtccgccatatagtaccctgtttcgcaacagatcaagcgcggtttcacagatacatggaatatcaatatgaatagtagtaaggggtggtgataaatactttgcaatattcacatcattgatgctaaaaaccgccacctgctccggaatctgtatattgccttcatttaaagcctgtagcacacccaccgccagtgtgtcacttgccacacaaagtgctgttggcagtatctcttttttaagcagttcttttcccatgcggtagccatcatccaccgtaaatctctcggaaatgaaaatgtactcctcattgagatacccatagtatgcagcgctctgtcgaaatgaccactcccggatatccatggaaggttttccggtgtcaatatttctatcactgcccccgataaatccaatccgtttatgtcctttttccacaaagtaatcaaccatctgtgtcacaaacgaatccatattgggcttcacggcatcaaaaagtttttcatccggggatgtgccgataaacacgccccttttgcaccgtttatacaaagcattgatttcttttctggtgagccatccaatcgcaataaaggcacttaaatctttcggaacatgatccatgccgtcttttcggtcatagatgctgagctgaatattcatctttttcgcctgctttattatctcatcctttaccccgtggtaaaagacatcttcgagttcatcctcgtggtcaacaaaatacagcaatgccacattttcgatcttgggatagattactctctttttgtatccgattttctctgctgtggcaaagatcgcctctcttgtctcatcactaacagagattccctcatcataattgagtacccgtgaaactgctgagctcgaaacccctacgatttctgcaatttctttaattgttgccatacgattcctccaatgttttcatggatttctttattgataaattctgttataattattttacataaatattttactttgtcaaacaaagttttgcacataaaaaaggcatacattcctcaaaggatcatgtatgcctttacaaaccgttacccaatcttatttcgtagaaaccgtagaagctaccagctccagatttccttctatctcgacattaccgtatccacaaggaagaataaaatgatctcccttcttgacactggtatgattcaaaagaccattgccctcgactacgctgacgatcaggaacggataagactgctcaaactcagccttcccatccactttcatgtggaatacctgataatacttacactcaataagtttctgcagtttgtttgtctccgctgccccagtctcgatcatgcactcggacatcggtgctgccggaactttgatgacatcgagactctgctgtacatgaagctgacgcggtttgccgttggaaagacggtcataatcatagacacgataggtaatatcactgttctgctgtgtctcaagaattgtaattccacccttgattgcatgtaccgttcccggatcaatctggatgaaatcacctttctttaccggaacctcacggatcaattcactccagcgtccgttgtgtaccatgtcttccagttcctcgtgtgtctttgcattgtgaccgataaccagcttggaatccggctcacagtctaagatataccagcactccatcttaccgagagaaccattttcatgctctgcggcataggtatcatccggatgtacctgaatacttaaatccgcctttgcatcaataatcttgatcagcagcgggaataccttcccctgtgtatttccaaagagttctctgtgttcctcccacagatcggataatttctttcccttatacgcaccgtctgcaatcgtacaagttccgtttggatgtgctgcgattccccagcattctccgatgtcatcgccctcaatggaatatccatactcttcacgaagctttgtaccaccccagatattgtgggtaaataccggctccataaagaggatctgcttatacggctggttacaacttaaattttctccattcattctcatcacctctctgtaccaatatgcggaatcttttgcaatcctgcgttgggttgtgtagtctacataaacaagtccaaaacgttctttgtaaccttctgcccactcgaagttatccagaaatgtccagaggaaatatccgataaccggcattccctcgttaatcgcacgctgtaccgctccaagatacgcatccagaaacgtaatcctctctctgtcgtgcacctgtccgtctgcggaaatattgtcaagatccgacatcccgttttccgtaatataaagcggcagtctgtaacgctcggtaaggaaacggatgccatagtaaagtgcctccggtgtcaccggccagccggttcctgtctttgctgtgcccggtgcacgatccacatactccgggtctccatccgctccacagcggatcatgtaaccgttgtaaatattctgtcccacgaaatcaagtggctgatgaatcagctgcatgtcttcttcggtaatctccggaagatagtctgcaaacttctccagcccctctttcggatactctcctaaaaataccggatcggaaaaccatgccacattccaggtccagttatccatcggattttcaaatccaaagtacactttctttgctgctgcgatatcatcggcactctctgtcgccggatatgcaacgccacaagtcggagcatatccaacccgtatcttctgttttgcatatttgcgcagattgatcactgcctgaccatgtgctttcatcagattgtgtgccatctgaaaggtctctggaacagaatactgcattcccggtgcatgtaccccgcttaagtgtcccagtccaatcgcacactgcggctcattgattgtgataaaatcggtacacagatcagagaaattttctgcaacgacttttgcatattctccaaaccactccaccacatcttcattgagccatccgccttttttaaacagctcatatggaaactcccaatgaaacatggtgataaacggacgaattccgttttctttcatgcaaagaatcatatcgcgatacatctgtacagctttctcattcaccttcccggttcccgccggaagaattcttgaccagttgagtgaaaaacgataatttttgattccaagtaaccgcatcaaagcaaaatcttctttataacggtgcatatgatcgcaggaaacatctgcagtctgttgttcatacaccctgccggaacgcacaaactcatcccacacattctttccacggccatcgtcaggatcggttccttccacctgataagcactgcttgccactccccagacaaaatcttttggaaacatatttttcttcctctctctatttttcagaaacaattacagagatcagttcaaatgcactcggcatggtagaatctccggaaatcagccgtatttccaccgtatgtgccccttcttttccatgcaccagaaccggagtcagcgtcagggaatccccccaatcctcatcaaagtttgcatccagtgtcaccgcatgtgcttcatccccatccacaatggccagtgccaccggcgccggtttcgttacacaacgcttatactgtgctgcaatctcacttccatttacagcaaacgttaacgatgctcctttttcttttgcggaccatccatttttgaagcaatctttgacttcttcctgtactctggtatctttgacaaatccctggttttcaggttcataattacgattatccagacgcactgctttttcatagcaattgtctgtcagtggttctgggaattctggttttgcatcctttgtctgtgttatatggattttctctaaggcataagtaatcacagatgcaaccagctcatgccctttgtcgtttggatgcagatcatcctctgtaatctcgcggtttggaatccgccccgcaacgacctcctgataaatactgctctgcatgctgaccgccggaagctgataatgtctggctatctgaccgtgcatgatctgcgcatttccaccgttattataataaacattgtgcaccagcatcacagcaggttcgtttttatcctgccatacacggcgtaccagtccttcatatgtctcacggaaaaattccgtcgattcatcattgaccgaaaattcaatgataacaaaatccggtttatgggaaagcagatcggactcggcacgggccgtcccgaaatgtgatgttgttccaccgattccggcattgatataatgaaatttggcctgcggaaatgttttctcccaccactgaaatacgcggtaagcataacacagctccggtgcggatgcaagacatccctgcgtgatcgaaccaccaaggaaaccaatgtttaatgtttccccggcctctgcccttgccattaattttttcatccggtacagattgcccggattggaaatacctctttcatattcaatctgcattgttatactccttatataatgtaatcaatttttttttaaaattgattacatatcccaaatctcctctccgaggctttcgatgaatgcggtaagttccttactcatctgttctgcctccggaatacggatatgccccggtgttccttttccgttctgtgaatacaggaaatggtgtacccgcggactgtttactgttttgcacacttcctcaatggaaatgtcccagttttcgttatgttccaatattgtggttgtcaatataaaggttgccttcggatatacttccataagatgctctaaaaatctgcggtaatgctgccgccagttttcggaacgtgcactgttataatcttctgccatataatcatccgggtggttatcattctgcccgaatgcaaaaatcacaacatctggtgtataacgtgaaaaatcccatggttttacttcactgagttccggctggtattctattttatcataacaggattctattcccagataatccggctccataaaccagccggttttgtcaagaagggcgataccaccctgtgatgtgtcatgcaactgtgcatgcagattccgcgcggtcatccacgcataagaataccagctgtttgaatattccccatcgtgttccgggtccggttttcccacataatctacggcctctgatacttcgccgcaggaaacactgtctccgaaaacttcgattttacgggacggaagcggtgccggagtaagtacctcggcatcgcttcccaattcaaatcccagtaatgtgacgatatggcaggaatccattcttttaaacagagtgagggtatgttctgtatttttaagatctttagcaatcacatatgtttttgcctccggatctgaggtgagtaagaactgtccctgcttcccgtccaatatatatcccatccggctcgaccagtatgcccgtttgtttgccagcgttaccgaaatttccgttccggtaaaacgaatctgaacaaaacttgccgcatagacaagtacgggttcctttggattatcaaaatcaattcttccacaatattgtaatctcttgtcgtccgatgaaatatgcataattatctccttccgatttccgtgtctgtaggtgttacaacactgttcgtcttgatgtaatctacaatctcatccagctttgtaaatgccaggccaacgtagctgtctgctgcgccatagtagatggcgatctttccggatgcactgtcgtgaatggttgcacatgggaagcatacgttcggaacgaaacctctctcctcataccactcttccggtgtcagaaggaaattctcacagcggtacttcacgatggaaggattatcaatgtcaaggattgctccaccgatggaataaacatatccgttacatgtaccggataccccatggtaaaataacagccatccttcggaagtctcgatcggagcagcaccgccaccgatctttaaggactcccaccattcacttcctttgcccatgacatgtctgtgtttgccccagtataccagatccgggctttcacttaagaaaatgtcaccaaacggtgtatgaccactgtctgaaggacgggaaagcatcatgaagtttccattgatttttctagggaacagcacggcattgcggttgaatgggaggaacggattctcaatacgtgtaaacgtcttgaaatctgttgtttttgccatgccgattgctgctccgtagaaatcctgacaccagatgatataataggtgtcttctacttttacaagtcttggatcgtatgcatagattggcataaacggttcgccgttttcatctacaaacggaatcttgttttcttcaaaatcccagtggatggcatctttgctgtgtccaagataaatatatggaataccattggtctgctctccacggaacacaccgatgaaagcatcaccatatggcataaccgcactgttaaaaattcttgcaacaccctttaacggatttcttccgataatcgggttttcactgtatctccagatcggggctccgttctgaggtccttgtggtctctcctgccatggtacatttggtaccggagctgtcagcatctttacttcactcataatcaactctcctcttatttatgattttttaaatactctaaatttttcttaatcaggtcgcatctctgctgtacacacagtacacttcttcccgggtcctgtggtgtattaaatacataatcgatcagacggtcaatcgttgtagtagccacatgcattcttgtatcagaagaagcatagtaaataaatacttcgttcttatcgtttacgattgcaccgttggtaaatacaacatttgatacatctccgacacgctcctcgcctctcggtccgattaacagtccggatggctctgcaattaccttagacggatcgtttaaatccgtggcaaatgcatagatcacatagcgcagacctgctgcagtatttcttacgccgtgtgcaatatgaatccagccgcgatcagtcctgatcggagtagcacctgcaccgttctttgcctcggtaatggtgtggtacttacggatgctggtcatcttttcttcgtcaatgactgcatgtgtgatatcatcgcaaagaccgaatccaataccgcttccgcttccggtatcaatgaagtcatccatcggacgggtatagaatgcatactttccatctacaaattccggatgcagcacgacatttctctgctgtggagaacgaagggtctttaagttttccagacgctcccagtgctttaaatcttttgtgcggacaatacctgctgctgcaactgccgcagacagatcgttcacgctggtatctttgctctcggaacagaatactccgtaaatgtatccgtcctcatgctgtgtcagtctcatatcatagacgtttgtctcctccggacatacatcatccagaaggatcgggtaatcccagaaacggaaattatcaattccgttatcactctctgccacgccgaagaaggactttctgtcatttccctcaatacgggcaaccagataatactttccgtttaaataaattgctccggaattcatgactgcattgattccaagacgttccataaagaatggattggtctcctcgtttaagtcatatctccaggtgagcggaatcatatctcttgtaagaacgggattcacataacggtcaaatacaccattataaaagtcacttttttcatttttacgtgaaagcagcttttcctgctttgccagttctacataatatctttcatgcattgtttaaagtctccttattacttccatacacattcttccgttatgatacggacatttccaaggttctacgattggacggtccgcaatcggactgccgtccggatgtacttcccagaaccactcggaaccggttctcttatcaatgacgtgttctttgataaattcccattcagcctccgatgcctccagaaacttcgttttctgcggatgcttctggtattcattcaggaatccgatcacagtctctgcctgtacccaccagatccggtggtcattcacttcccctttgcagcattcatttgccagagaatgaccgtcaaacgcaacctcgtagacattttctgcaagagtctcggtaatcggtgacattttttctttgtaatgatcatccccaagcacttccacaccgcggtccatcagccatgctgtctcaatatcatgaccataagaatacagatcaatgatggtgttgtagttcttgtcaaagaatacttcctgtctcttaagtttcggattgtataccttatctgcaaatacatccataatccactttaaccgctctcccacctcttcatcatgggaaacccggtaaaactcggtataagcctcaaacacatgaagcagtgtgttcatggttttttcggcaagcacaccattttccgatagcttctcattggattccggctggaagtctttggtaaatgcttccagatatccaacctcatccgtacatttgctttcaataagaagctgcagttctttggcaagctttaatgcttcttcatccccggatgcatcgtaataggaagaaagagcatagatgcagaatgcctgattgtaggtatgctttgttgtgtcaagtggctttccgtcataagtcatgaaccagaagattccaccattttctttgtcgatgcagtgatcacgcaggaactcataaccgtgtcttgcctcgtccagcaaggtttcatctttcagcagtatgtaggcattcgcaaaaaaccaggtgattctgctgtttaaaatacatcccttttctgctgttttgtctacgtttaaattgtagtccatatatccataatatccaccgtaagtatcgtcccttaatgctttccagaaaggaatgatattttccgtcaaatgctttgtgacttcttctttcatcatgctcttattcatcccgatacctcttattttccaaaatcattaaccctttaccgcacctgctgtaattccactgtaaatctgtttctggcagcagacaaatacgatcagcgccggaagcagggagataataacacctgcacagatcagattgtacttgcttcccattggtcctacgaatgtgtagagggaaagtgccatggtacggatctcttttctcatcaggtaaaggtttgctgcgtagtattcgttgtacacaccaacaccctttaaaatacaggatgtaacgattgccggttttaacagtggaagcataatcttccagtaaatctgccagtaatttgcgccatcgataattgccgactcatccagtgaaagcggaatattttccataaactgaatgaaaatatacatggaaataacatcggtaccacagctcataatgatgtaaccgcccagactgtttacaagatgtaaatctgacataatctggtatacggtaacctgcattgctactgccggaagcagtgcggcaattgtatacaggttacggataaacccattgcctgggaacttgaaacgattcaatacgtaagcaagctgggaacctacaataacggatacagtaagcacaaccaccataactatgacagagtttaaaaatgcgcgtcccatatttgccgtcttaaatgcatttacaaagttgtcaaaattcagccagcttcccggaaatgccataacattggtattctggtactcggcatctgtcttaaatgccgttgtgatacaggaaacaatcggaatgattgcacagaatccgaaaaagatcagcgatgcatattccacaataatccagataatgcttcctacggaataatgtttcatgtttttacgttttactgctgctgctgtactactcattatttcgccgctcctttcttcattttctcctgttttttgatctgcttaatcacctgtttttctgccttcagccgggctttctttgccttataggattcatcctccgacgcggcatccctgaacacatatttaaagaacacattctgtaagatcgtacagataaagatgatcatcagcagaacaacagacatggccgatgccagacctactttctggctggtatgtgcgatcttgttcataattacgaaatacgttcctgttccgtttgcaccggtggtgattacgaaaggcgcctcaaacgcacttaaggaaccggtgatggaaaggataacatttaatgtaataattgtcttgatactcgggagaataatgtgtttaaactgctcccatttatttgcaccatccagggacgctgcttcgtagagttcgctatccacagacatcatggcaccaataaacagtaccatattctgtccggtataccgccatacggaagtcgccgtcagggaccagttgtttacactctgatcctttaaccagtatggaagattttctaattgaaacccacaccactgcaggattgtatcaaatacgaatcctctggtgaagaagaatttaaagataaaaccaatggcaataccactgatgaggtaagggaaaaacatcagccctttgaaaagatttccaccctttaccttaaagcttaaaattgttgcaagatacagtgcaagcacaagctggatcaatgcaccgaccatatagaataaactaagtttcaacgccccgaaacaatcttttcttctgaatacatcaagatagttgtcccatccgacaaattcgcgcctgtctattggcgttgtatatttcatcttataaaaactaaatttgatcatttccgcaaatggaaaataagtgaataaaaagagtaagagcaatgggataatcataaaaccgatacagataaatacctgctggccggctctgctctttgcccattttttaaaattaaatgattttgatttcatactatgttcctcccatatgaaacaggcaatcatgccaccgggccgaaaacagtttttcgacccggcagctggatgatgtacctttatgcagcgtggaactactctgtaatttctacgccctcagattcctgagcatctgtccatttctggttccactcgttcataatatcatcaaagctctcatcgccatttgctgcatgctcaatgattgcctgaatcttatcattaccgccgttgttaatgttcagttctgaatcagcatttaatgcatttaaaagatcctcttcgccttctacagccggttcatcctcaaggaatgtcacaccagagaaatcaagctttgtatcagaagatgactttgcaaccggaagcccatcctcgttgtaagaaaatccagacttttcagtcatccacttaacaaagattaaagctgcctgcttctcatcatcagaagcgtttacgttgataccgtaagagtaatctgctccggctgatgcatactgctcaccgtttacagaaatcgggaatggcatatatccgatgtcatctgcgttctcaccggctgcttccatctgtgggtaagcccatgatccaagtaccatacatccgatctgtccgttgtttaacatgctcttagagccttcccagtcagttgtagaatagtcatcctcggtaagtccgccagcaactgcatcgtaaaggatcttgtatactgcatatggatgtgtgccatcgccataatccttgaatggatcctttgtatgaaggagtttctggttgaaatatgtattgtcaccagttgcattgtttccgatataagcatcccatgcacccattgtccagcctgctgcatagtttgtgtaaagcggaattgcatccgtcttgtccttgatcttctttaatgcatcaatgaactcgtccggagtctttggaacatcggtcacaccggcatcctcaaacactttcttgttgtaaacgataccctgtgtcgttgctgtggaaggaacaccgtatacatcatttccatagagccatgtgtttgcgtagttgatctgctggctcatctcatcaagtgtaccgtatgacatataatatgtactgaggtctgccttatctactgccggaatcatggtaatggtttcgtactgtccggactgtaaatgtgtcagtgcatcatcggcatagtttgtatctgtagtgatttcaaccttgatattcggatactctttgttgaagtcttccagataagatttccagttctttccgccgtaatcatcggtatccatatctgttctgtggttgaacattgtaattgttgcgtttaagtcttttcctgtttctcccaatacaatgtctgaatagcttacaagaccatctgcggaagcgctgtctgatttctgtgtggtatcagcagaatcatttcccttagaaccgcatcctgcgaataatgttgcggtcattgcagctacaagaccaagtgccataaactttttaaatttcatgttgttctcctccttaaacatgtgaattattaagttaatttaagtatacattttttgttaatttaatcatcactctttattgcttttaatcatatcatattgcgttttcaaacacattccctataatgcacaattttacatttacttttttatgcattatgtctatatatttttgtccaaaaagtaattttaagttatatttcattttaaattattgctttttacctttcatccaattatacttaattaaaaactggttatgattgaaagaggatgattttatggaacaattacagcatcatgggattacaggaacggtgccaaagcatgtattatctgacaacatgaaaaactttacggcttttccgctgtccgcaccagcggatgacggctttattcatctgctcggaaaaggcatctgttcctttccgaacaattgttccatgacattccgtatcaacgcgccttatcattttttctatgtatatgaaggcactctttctgtaacggatgaacatcatacgtgtcggctggcagaccggcacgcagcgcttcttccgatttccggtcccctcacgatcgaaatcttaaaaggccactgccactatttccatatgtatatttccggtctcgccctcctgcagtttcacacactgctcccatcacctcttgcctatccgacagagagttcttctatgtttactctgttccatacgatggagcatttacagaatctgcagaaagacacttttaatgatcctctgtccgtctgccggatctccatgtggatcaccaatattcttacggaaatggctgtctattccggccatcctgccacacgccgggatacgatcccggattatctgtgggaaattcatcatttatttgacacacaatacggagaaaattattcactggacgaactggaaaatacatattccgtcagcaaataccggatctgccgcgagttttctaaatactatggggcttctcctgtccagtacttaaaccataagcggattgaagaggctaaaaaactgcttctgactaccaacgacaccatacacgaaatcggaagcaaggtaggaattcataataccaatcattttatcaatctgtttaaacgggaaaccggggcaaccccacttgcatttaagcaggatgccccggtttctatatccgagctacactatctttaaataccacatgtccatctacaatgaacacaccggctgtatagttttcatttgcaattttgcggacaatcttgtgaatggctctgcgtgccatctccgatatatccacctcatatgtcgtaattccgatatcgcacagccccggataaagaaaattatcaaatcccacaacggaaacatcttccggaacccggtagccttcattttcaagtttccggatcagatacgaagctgcaagatcgcagttacagacaaatgccgtcggcatatctttcggaaatttataatatttttccagatccatccgcccggttttggtatcccggtcatcaatcacataatcttttggcacatccactctgtgttccatcatagacttgcggtaaccaagatatcggtctgtaatactgtttgtcatgccaaccgttcctacataggcaatttttgtatgccccatggaaaaaagataattcgtcagtgcataggtgccgtaaaaactattggaaataactgtgtccagaccaacggcatcgttataaaaatccagacagaccaccggcacgccgccctctttttcaatcttttcaatgtatggttttgtcatatcgccaagaatgatcagaccatccacctttttttcctgaagcagaagcggcatctggttttccagcacactctcccttgaaatactttcgagcagcgtaaaacacccacgggaaactgccctcttgtttacttcctgatacattttccagtaaaaggaagcgtatttgtccagatatacttcctgtatcaggactccgatattatattgtttttccgcagactgccgttttgtctccgaaggactgcggtaaccaagctcttctgcaaggttctttattttctcccgcatctcttcactgacgcctttttgtcccgacaaggctttggaaacggttaccgtgctgacaccaacctgttcggcgatatctgcaagtttcactgcttttgccataattccctcgatattttcatactaatttacttatttaactatataaactggataatttaagttgattttacattctttttcttcctctgtcaattaatctgccacaaaatggtacagataacttctgtaatctccctgctcggaaggaaccagcataccggcattcataagcagatctccgccgtatacgcattcgttctccatctcaccttccagacgataatccagattcggattcagtccctgcaggcgtacttttaaactgtggtaattcgggcgtgcgtgtacggtcacgaaagtaactagtgcctcttttttatctttggatactaccatataacaatcgtagaaatgattttcccggtaagaagcgatacggtaataatccccctcccttaccagatcgttatacttgtgatacatagctgtctgctgtggaatctgttcctgctcttcctttgcaatctttgtgatatccaactcataaccaaaggttcctgccagggcaacttcccctcttgtcttaaacggggtatttctgcccacggtatggttcgggcagtccgaaacgtgtgctcccattgcagacaatggataaatcagtgccgtaccttcctgaatgccaagtctctcgattgcatccgtatcatccgagcaccagatctgtgggctgtaataaagcatacccggatcaaaacgtgctccaccaccggaacagttctccagaagaagatccgggaaatcacgggtcaggcgttcctgcatctcatacacaccaagcacataacggtggcttaactccccctggcggtctgccggaagcgcaaggcttcccagatcggtaagctgacggttcatatcccacttcacatattcgatattggcactgtttaaaattgcacggatcttttcatagatgcagtccctcacatcttttctgctgaaatcaaggacatactgatttctcgaaagcgttccggtgcgtcctttcacagcaattgcccagtccggatgctctttgtacaattccgaatccggggaaatcatttccggttccatccagataccgaatttcatgccaagcttattcacttcatctaccagatagttcaatccgcccggcagtttcttttcattaacaaaccagtccccaagacttgtactgtcatcgttgcggtgtccaaaccagccatcatccataaccagcatttcaattccgtactgagaggcaagttttgcaatatctaaaagtttttcggtattgaaatcaaagtaggttgcttcccagttgttgatcagaatcgggcgtttctgattgcggtatttgctgcggattaaatgattccgatagaagtcgtggaaattacgggtcatttttccaagtccctctgcggaaaatgtaagggcagcttccggtgtataaaatgattcttcactttccagtttccaggaaaaatctgccggatgaattcccatgactgcacggatactgtcaaactggcttttttccagctgtgcgataaaattgccggaataaataaaatgcatggcatacacttcgccggctgtctgtgtcgtggaagatttcatccatgccataaatgggtgttcctgatgggaggactccccacggatacttcccacactggtctttccatatcccagcggacggcggtccatctggcgttctcttgcccatgaaccgtgaagtgtcagcatctcgtaggcatcatcatccatatccatgcatgccgaatatgcttttgtgaggtaaactgcctctttgctctgattgctgatgcgcacgcttctggtaatcatatcgttttcttcaaacacggtataatacagatccacatccagctgcaacacttcatccctgcagcgaagaatcagtgtctgtgcagtatgctccctgtcaaatgcggacggaagtcccggaagctgcggtttctgatctgtaatttcataggaaacatacgtcggcataaccgcatgctgacctgcctgtgttcgcacagcaatgctgctttcccgataatctcccactccgtttccggaatactccgatggaaacgtatcataaaaagaacagcgctctctttcattctccgatggaacaaacggtgcctctccggtacggagcaggtagcgcagatcctgtccgcgcacacgcctgccgtaatatacgtggcctacaaaggtccgatggtctgcaagacctatgatatagctggtattcgctgtctccagacaaaacagatccagattttcatcaaatacgatactcatgttaatcctccagtatgttttcttctataaatttcactgccaggtccttgttttttaaaccttctgccagacctaccacacaggtatccggataccagccggtttccttcacccaggcatttttttctaactttatgccgatcggatattttttccctgtttcggtactttttacatacaccagatcatccttatatttttccagcaattcttctggcaaatattcccggatgtctgccagatagtcaaactctcccagtgaataaaagaaatcatagtcggaaaaaaacacatccacggactgtgtcataaagaggctctgaatcatctgaatgctctctgcggatgccccgtcgttctcatttgccgaggctcccagattactgctgacaagcacttcgcttttatccggatccagtccgttttcttttaggaaatcattataataaccggaatccccagccggattgtcagcagactgtatggcatttactgccataatttccagtgcggtatccttttgcgtaatataatggatgatcagaaagctgatggttcctataatggcaagtgcgaccatggtctgcaatccatagtaatgaaccagataccatattttatcttttccatgcagttcctttaacttttctctttctgtcttcggctcctcttttttatagaggatgctgtcttctcctgctttggaaaaatccggttttatattcttctgatcatccataaattttattctcctgcgtatgtaagcattgcgttgcgcagctcatccagtttcttttcggaatctttgatgtccgttcctacaacgccaaaatagaatttgatctttggctctgttccggatggacgtacacagcaccatgcattgttgctcagttcataataaagaacgttgctttccggaagtccggttggtgtaacttctccgcctgtcatatctgttcttgtatctttcttgtaatcacgaagtgctaaaacatcccatgcaccgatcttcttcggcgggttgttgcgcatctcattcatcatgctctggatcttttctgcaccatccataccctttaaggtcatggtctccaatccctctttgtaataaccgtacttcccgtacagggaaagcatgtcatcccagagcgtgattccattggatttgcaccatgccgctacctcgcagagcatcatgactgccacacaggcatccttgtccctggcataagttcctgccaaacatccgtagctttcttccaggccaaagacatactcataactgttctgctgctcaaaaaatttgatctgctcaccgatatacttaaatccggtcagtacctcgatcagttttactccgtaagcttttgcgattgcctttgccatgtcggtggttacgatggtctctaccagagctccgtttgccggaagtgttccgtttgctttcttctcacgcagaatgtactctgcaatcagcataccggacatatttccagtgaaacttacatactctcctgtcttggtatcctttgcatacacacccagacgatcggcatccggatcggttgccagaacgatatccgcatctacttcttttgccagtttcaatgcaagctcaaatgcctttggcgactctggattcggataggaaacggtcgggaaatttccatccggaagttcctgctcttttactacatagacattttcaaatcccagttcttttaatacacggcgtaccgggagatttcctgttccatgtaacggagtgtaaacaatcttgatatcttttgccatcgctttgatgatttccgggtggatcgactgttttttgagttcttccatataacggtcatccatttcttttccgatggtatgataaagtcctgcagcttcggcctcagatttcatcatagtcttcacctgtgaaaaatcagtgacttttgccacttctgcaagaatatttttatcgtgtggcggagtaatctgtgcgccatcctcccagtatactttgtatccgttatactcacgcggattatggcttgccgtaatcacgatacctgcaatacatccaagttcacggacggaaaatgacagttccggtgtcggacgcagagattcaaaacgataagtcttaatcccgtttgcattcaggcagagtgctgcttcatcggaaaactccggggacatgatacgggaatcgtatgcgatcgcaactcccttgtcctgtccgttctgggaaatgatgtagtttgccagtccctgggttgcctgacgaaccgtataaatattcatacggtttgttcctgcgccgattaccccgcgcagaccaccagtaccaaactccagctgacggtaaaaacgatcctcgatctctgcatcatttccttgtagtgccagcagttcttttttggtatcctcatcaaaataattgtctgtgcaccattttttgtatgtatccatataactcatttcaggtcccccttctattcagctttttatttaagtataccataatttaagtttgtgtaaatatgtttttagtcagaatttaagctaaattttcattctgaaacttgtgaaaatttccaatagatgatgtctgctgccgctttcccgtagacttcataatcccctcttttgacaggatttctgccgtctccatgccatgcagcccattcccagatgccaaatccgcctacccagtctctcttttcgcaggcatcaaacatcgcctgaaaccagtctgcctgtcctttttcatcatagtccccacgcacgccccagtcattcggcacctgattggaacctttcacagacatacagccggcttccgcaaagaaaaacggcttatcaaacttctttaccacctgttcaatacgatccagctgattgtcccaatcgtcaatcggataatacccgctggatgaaatcacatctaccgcatcccaccatttcacattgtgttcctggtacttatccgtattgtaggaaaccagtccatcatacctccggcgaattgccgcaatcacttcccgccattccgcttcgcggcgctcggtctgcaccatctcgcagcctgcaataaacagatccactccgcactgctgcgcaagtccagcatagtgttcctgaaatgcccggtaagaggcgaaccaattgctccacttcggttcacacacgacatcttcatcaaagaaattgatatgtgcacgccatgttccgtccgcacagtttgccgttggctttaacgccaccttaaggccaagctgttttgcgtaagcaatcatggcagtcagctcctcatccgatacattccgcttggtccggtaatcaatggtctcggaaaatgctgtcttctgcacaccgttcggtgcaaaaatcacatagtttgctcccgtcttttctttcatcagtttcagactctgtctggtttcttctttttcaaaggtacctcttgcacaaaatggtgcaaaggtaactgcatgtatacgctccataatattctctcctgttttcgtttttgtgtccgggtatcgtttcgaccgtttctgcgggccgtctgtctgtaagggactccgttcgcgatttctagtctgcctaagagggaaccttcgaaacgtttattgcgcccactctcatttgtcttgatatatacaaccgtttatatattttattctgtgactgcgcaaattgaaccgtgggcgcgcttattcgaagcctccctctaaggcacacacgaaatcactcagacggtgtccttacagacagacggcccgcagaaactattgaacgttaatcgcagatccgaccatgtgagaggctgcaggctcggaaaaaagtttcgaaatcaccaacttattgtcatgcgtattatcttaccttttttttcggcaatccgcaacttgaaaaacagtcatttattatgtaaaataaagcaaatacgaaaagagaggactgggaatatgcatacggaaaataaaaaagaactggcgctggaaatcatccgccgtctgaaacaggcgtacccggatgccgcctgcagcctagattacaacgaagcctggaagcttctcgtcagtgtccgcctggccgcacagtgtaccgatgcccgcgtaaacatgatcgtaccgaaattgtatgaaaaatttccggatgtcaatgccctggcagatgcacccgtggaagaaatcgaagaaattgtgcgtccctgtggactgggaaaaagcaaggcaagggatatcagtgcctgcatgcggatgctgcgggatgtgtatggtggaaatgttccaaacgattttaatgccctgttaaagctgccgggtgtcggacgcaaaagtgccaatctgattatgggagatgtatttggaaaaccggcgatcgtgacggacacgcactgcatccgcctgagcaaccggatcggattggtggatcacatcaaagatccaaagaaagtagaaatggaattgtggaagatcattcctccggaagaaggcaacgatctgtgccaccgttttgtactgcacggacgtgacatctgcacggcccgcaccacaccgcactgcgaacactgctgcctgcaggatatctgtgcacagcggatttaagatttcagcaggcgctgcatatcttccggaagcggtgccataaagttcatcggctgtccggtcatgggatgcggaaacgaaagtttccatgcatgcagtgcctgacggccaatatcatattgctcttttccacaggaaaaagtctttccctgaaaaatctgtctctccccggaattttcatcgtcccgacggtcaatctgattttccccgtatgccggattataaagaaaatctcccaccagcggatgtcccagatatgccatatgcacgcggatctggtgggttctcccggtctcaagctgaagttttaccagactgcgaaacttctgtgcatttccggtctgccatccggtcagaacccggtaatgcgtcaccgcccggtctccccgcttaagatcaaccacacggcgcaggcagcggtcctcctgtctggcaatcggtgcatcaatgacgccggaaaccggcacaacctttccctccacaagcgcaagatacgtccggtgaatcccgggtgcttttagtccctgctcggcttttgccctcaccatctgcccgaggatcgccgcagaaaccgcatgttttgccacaatagtaagcccggaggtatcccggtccagccggttgatacagcggaacacaaagggaaccccctgctctttgaaataccatgccagtgcattgccgagagaattctccggattcccgcgggatggatgaaccggcattcctgccggtttgttgatcacaagcagatcctcatcctcataaacgatggcaaacggcagttttaccggacggatctgtccggaattttccgtttcccgaatccatacggtcagaacatctccttctgcaagcatgtggttcatatgtacatacgttccgttcaggcagattgcctgttcgtttttacgcagatctacaagattctgccgggaataccctttttcttttaaaaatccactgattttctgtggtttctccagaccgttaatctgatataatacgcttctgtccataatggtcatcattgatctctttgccaggtaaatgtccccctgtatgtaagattctccggtctagaagctttgatacgttctgacggatacactgtctccgctaccacaaaccagccaatcaccgcaatcatcagaagataaaataaaagtacttcctttttattccccatatactttttcatctttcagtttctcaccctgtcctttatactttatattttgcattcatatgttttcttttaattattccataactataccggaaatgcaagcaccacgttacggttcactcagcactgcgccatgtcacgcaaaaaaagggattaccacccatttcgtggtaatcccctgaaaagaaaactcagattgttccggttacggtaagtgtgcctgcccccggtgtcactgtccactcgccggttgtggcatcctgcgtaaaggttgctgccggtacggtaatctgcccttcctgcgtcgcaaaagtaccggtcgcggcattgtaggaataatttgccggatccgaccatgccgttccattatacgataccgcaagattcgaaagtaccggatcgaatgtatctgtcaccactgcgccggttgccgccagtgccgcagtatttccggtattctggataaggaacgtataggtcagtgttccattttccgtaaccggaaccggactgacggatttggtgattgtcagcttcggaccactttccgcgatgacggtttcctttgcggtaaccggtgtaattccccctccggaaacggtcaccgtgttggtaatctccgattccgccaaaagaggtgcaaacgcattggtttctgcctcatatacaatggtcacgtttccccccgccggtacactgatcccggaaacggaaaggggtggtcctgccgtgactgccggtgttgtctgtaagattccattgctgtaataacgcacggtatctgccacatacgtcagtggcaccagtgtgtctgtgccaaatgcatatgcccccagatcatctgcaaccgtcagtcctgtcatggctgtatttccggaattcactatgctcacaacataggtgacacggtcattctgcccgtatgttttgcgtaccgcagttttggttgcggcaagtacctcaaggatttctcccactgcaacgttggaattggctacagcgtttccatagcggagctgtgcctgattggtaaatattgccatttttttgcatcctttcattttattcaggtatgctttatcatatgacagaaattttccatatgtgcagccgcaccatcactattctttcaaatatatttccggtcttctgtcccggaacagcccccagcttcttctttcttcttctatttcatccagatcaaacgtatgcaggataaagccttctgataccctgtccatctcttctgtcacttcccctgttgcgtctgtgataaaagaggaaccgtaaaatgtgagggctgagctctgctgtccattttccgcgcacggttccacggtttctgtcccgatcctgtttgcagcaatgaccggcataagattacatgccgcatgccccatcatgcaccgtctccaatgcggcatgctgtcgcagccaagtatcggctcgcttccgattgcagttggatagaaaaggagttccgccccttttagtgccaagcctcttgccgtctccggaaaccactgatcccagcagattccaacaccaatcgtcccatatctggttttaaatgcccgaaaccctgtatcaccgggcgtaaaataaaatttttcctgataataatggtcgtccggaatatgtgttttcctgtaaatgccgcgcacacttccatcggcatcaatgactgccacggaattgaacatctgtctgtaatccccggcttcataaaagctcaccggaatcaccgtttccagctcttttgccagttttttcatatggatgacagcatcattttcctctggcgttcttgcatatccataatattcataccttctctcctgacagaaatacggtctttcgaaaagttcaggaggaagaatgacctgcgccccctgtgcagcggcctccctgatcagttccgatgctttttctatattttcttttacatcgctgccgcagcccatctgtatggcagccactgtggtttttctcatatcatgctcctcccatcctcccggaatcagccggtatctgctgtgtaatacaatgaatgttcccaccaccgacaataatatcacgtgcgtaaaccgggtatactttccttccgggaaaaagcccccctatgatgttcacagcctctgcatccatttcatcctcaaactggggaatcaggactcctccatttgtaatataaaaattaacatagcttgcggcaagccgctcccctgcttttcgctgctcctccccctcttcaaaggaaaaaccggcaagttcatattccgttatacaaaccggcttccccggaaccgggactttgtggactatgagcttccgccccctggcatctgtctctttttccaatattgcaagatctgcagatgacaagggatactgcggatctttgggatcctccgtccacgcaagcaccacatgtccgggagcggtaaatgcacagacattgtctatgtgtccgtttgtctcatcgttgtagattccatatggaatccagatgattttttctgccccaagatagtcctttaacttctgtccgatcttttcttttgaaagctccggattcctgcctttgctgagcagacagctttctgtcacaaggatggttccctctccatcggtatggattgccccgccttctaacacaaacggatgcgcatcatacagatcatatcctgtcttccggcaaaaagaggacgctactttatcatccttttcccagtctgcatacaatccgtcacagattccaccccatgcattaaaacaccagtcaattccccgtacctgcccctgcccattgacaacaaaggtcggtccgacatccctcgcccatgcatcatccgatgcaatttccatataatggaccggataatttttctgatagtttttttctttccggacagcttcaattatcatttgtgcatgatccagctcccctgcttccaccagcagatataccgtctcggattccgcagcggcacatatgacatccgcaaaagcctctcttgccttttttgcaccatatatccaggaacccggccgtttcggccatataagtattgtccctttatgcggttcatactccgccggcatatgaaatccatccttgctaggacaaccttcctttaaaatcttcatatccaaatctcctgattaccctgcattctttatctgcccccataactgcgatgtccggaagcggcataccgttaaacgtattatttttgaccatggaataaattgccatgtcacagaatgtaagcctgttgcccacttttatctctttatcaaatgagtaatcaccgatcacatcacctgccagacaggtacaggaagaaagccggtacgtatatgctttctcccctgcttttccactgtccttaagcggcggacgatacggcatttcgagtacatccggcatatggcatgccgctgaagtgtccagaaccagtatctttatcccattgttttcgacaatatcgagcacggttgtctcaagatagcctgcattcagggctactgcctcccccggctcaagataaatttcaaggtcatatgtttcctgcatgcgccggatacagttctccagtttttccatgtcgtaaccggcttttgtgatatgatgtccgccacccatattaagccatttccgtccgtacagcagatctccaaactttttttccacagcaacaagtgtcgtttccagggcatccgaattctgttcacagagcgtatggaagtgaaacccatctatctgcgacaggtcaaaaccgttttgtatggctttgtcaagctctgccctcgttagaccaagccttgaacctgtaccgcacggatcataaatctcatgcccttcctgtgtagaacactccgggttaattctaagtcctgtacttacccctgcggctgcttctttgattttttccttatgaaccagaaactgggaaacggaattaaaaacaatatggtcacatatttttaccagttcgtccatttcttccggcagatatgccggacagaagacatggttttctttccccatctcttcctgtgccagacgtgcttcatacagcccgcttgccgtcgtcccacttaaatattttccaatcaggggatattcacaaaatgcgctgaatgctttctgtgcaagaaggatctttgcgcccgttctctgcattacatgatgcaaaatcttcaggttttctgtcagttttccctcatctatcacatagcagggagttttcagttcattaatcttcatccttccctccggctcaatccatatgaacagaagggtctgctgtcttgtaacaatccacggataccggattttcaactaccttccatggaagaccaaatttattcagtgcttccatatacggatccggatccatctcctcaagattgaataccccgggctttttccagagtcctgtcacaaccatcatggaacctatcattgccggtactcctgttgtataggaaactgcctgtgattccacttctttgtagcattcctgatggtcacatacattataaatataaatagatttcttttttccgtcctttatcccattaaaaatacatccgatatttgtcttccctactgtccgtggtccaagtgatgccggatccggaagcagttcttttaacacctgtaacggcaccacttcttttccgtctaccataatcgggtctgtccggagcattcccacatcctcaaggcatttcatgtgtgtaagataactctgtccaaacgtcatgaaaaaccggattcttttcacacccggaatatttttggcaagggattctatttcctcatggtggagaagatacatatctttttctccgacctggtcaaaattatactgtgcccgccactccatcggctcggtttctacccagtgcccatccgtccagtaggaaccgttagcggatacctcccgaagatttatctccggattaaagtttgtggcaaacggatatccatgatctccgccattacagtcaagtatatcaatggtgtggatttcatcaaaataatgtttctgcgcatatgccgtaaataccgatgtgacaccagggtcaaacccacttccaagaattgcggtaagtcctgcctccttgaatttttcctgataagcccactgccaggaataatcaaagtaagcggtaaatcccagttttttgcaccgcttctcataaatttccctccactgtggatcttgcgtatcctcgcactcgtagtttgcggtatcaatatagtcaactccacaggcaagacatgcatccataatcgtaagatcctgataagggagtgccacattgagcactgcatccggccggtacgaacggatcagtgtttttaattcttccacgttgtccgcgtcaacccttgccgtctcaattctggaagctgttttcccttcaagttttgcctttaaatcgtcacattttgacagggtacggcttgcaatcatgatgtccgtgaaaacttcactgttctgacagcattttctgattgccacctgtgcaacaccgccacatccaataataagtaatctgctcatttttattcctcctgtatcatttgttttaccgggtttcttcctcttcgagtaagtcctctacatattttggaagcataaatgccccccggtgtaaatttgtagtatagtaccatgttttcattccaagtgcatcccatctttctgcatcaagatcattcagcggatgatactttttagaagcgaatccgaataaccagtacccggaaggacaggtcgggatatgtgcctggtatacccggctgatcgggaatgacttgtagacttttctgtgcattttccggcattcagcctcatcctcgtcataaaacgggcttccatgctgatacaccatgattccgtcctcccggagagctttataacagcttccgtaaaattcttttgtaaaaagtccttccgtatgccccaatggatctgttgaatcgttgatgatcagatcgtattcatcatttttcccacgcagaaatctaagcccatcatcataatacattgaaattctgggatcctctaatccacatgccacctccgggaaaaattttctgcatacatcaacaaacattttatcggtttctaccacgtcaatcttttcaacaaacgggtattttatgagttctttcgccacacccccatccccgccaccaataatcagaattttttttgcattgggatggactgccatcggcacatgggtcaccatttcatcatatataaattcatctgcatcggaaaaaacaatttcaccatccaatgctgccatttttccaaattcataggatttaaatacatctatcttctgatattcacttttccccgaaaaaagctgctcctctatccggacatccagttttacattaactgtatgacattccgaaaaccacatttgcatatctttacctcctgttgccactcatgccagtacctgaagatattccactgccggatcttcggttccctgcatggagcatcctttttcttttgcatacagaatatattccgcaatctcttttgtaatccgttcccccggggcaaggatcggaatccccggtgggtagcacatgacaaactctccactgatgcatcccacggaatcttttatacttagcgattttttttctgcataaaaagctttctgcggagataccgccacctccggattgatatattccccggacaaaagccccgtcctgtccctgctgtataacctcttgatatcctgcaatgcccctacgagtctctcaatatcctgaattctgtcaccaatggaaatatacgcaaggatattacagatatcaccgaattcgatctgtatgtcatattcatcccggagcaggtcatatacttctattccggcaagcccgatatccaatgtataaacggacagcttggtgacatcgtaatcgtaaatgctggttccatttaccagatcacgcccataggcatagtaaccgccaatagaattaatttcatttctggcatattctgccatttttgcaactctggcaaaagattctcttccccgcaacgcaagatttcttcttgaaatatcaagactcgataaaaggagatacgatgcactggttgtctgtgtcagattgataatctgcctgacatgatctgcttttaccgctttcccggtaagaaggatggagctttgtgtaaggcttcccccggatttgtgcatggagatggcagacatgtctgcgcctgctgccataccacataccggaaggttttccccaaaatacagatgcgtcccatgtgcttcatctgtaagcaccttgattcctctggaatgagcaagttttacgattgcccggaggtctgaacatatcccgtaatacgtcggattgtttaccagaaccgcttttgcatccgggttgtcctcaatcgccctggcaacctggtctatttccattcctagagaaatcccaagtttcgcattcatctccggattcacataaaccggaactgccccacagagcaccagtgcattaagtgcacttttatgaacatttctcggtaatataattttatcgcccgccttacaggttgacaatatcattgcctgcactgccgatgtcgttcccccaaccatgaggaatgcattttctgcgccaaatgcatctgccgtcagttcttctgcttcgcggataacagaaaccggatggcacaaattatccagtggtttcatggaatttacgtccagttccacgcacttttgtccaagcagctgtaccagttccgggtttcccctgcctcttttgtgcccaggcacgtcaaatggaaccactcttctttttttaaattcctcaagtgcctcataaattggagctttctgctgtctattaatatccatttactactcctaactccttactgaaaaataacaggagcctccaagtcattttaactcaaaggctctttttcttacataactttatgcaagtgcaggttcttttcctgcaataatcgctttcacttcattttcaattctgtattcactggtctttctcctttttgtaacaaatattgttatccccaaaaagacatctgaccacacctatattataacttacccatttcttttatacaatcaatttttttgcattataatccatgattgttcagataatttgccacaccattgattccatcattggtatgaatatacctgtcaaaaaccatttgaataattttcacttcatcctctgccgtcttccacgcagattagcttcacaccataatcctgcataagctgtaaagagctgagtacatccgcataaattcctgacgaccttttatattctttatacctataaatcgtccgctcactgacattgttccgcttcgcaatttctaccattgtcataccgctcttctttaatatacttccatacgcctgatttatatattgttattattccttacgaattctttcaactacactttcctgactcatctttttaaactgatactttggaatcgcatatgcaattccacttaatatcggaaccataagcaggcacggcacgattgtaagatgcagttgaaagaaaaatgctgtaccaagcgtatttattaaaatctgctttgctccaaccacaactaacaatactgcaatcataaatgcgcctcccaaatataggaatccctcagccactagcattttcgatatctgttttttcgtcattccaacgacttccaaaagtgccagttctttttttctgctaattacagaagttgctgttgtattaaagaaattcataatgccaataaaggctaaaataacgacaagaaaactaccgatcatataatatttgctgacaaaccgcctaaagctcgccttcatatccaatacagaaaaaacatttatcatatcattttctttcaaaacatttttatcaatgtattcttttacttgcttatcctctccctgcctctttatttctaagctgcacagacactcttgcacgcaaaaccatcaagctaaacggtttcgtaatataatcatttgccccagcttccaatcctgttacaatatctacttccatgttatttactgtaagcagaataatcgacacctgactatttttccttatttctcttacaaaatcaatcccattcccatccggcaagttcacatctaataaaaccaatgtgatatcttcctttttcaagatttctctagcttcctgcaaagttctgcactgataaaagaaataggcatcattctttaaagccagacggattccatcatttaattttttgtcatcttcaacaatcagtaacttttcactcatattttctctgctttcttacaaattacgctaattgtatcattgccagttttataaatcaaatcattaagtcaaaagctccgacagaatttatcttataaacagcaaaaagctcccgaaggagctttccacgctttcaatatacactaattctttcaacacaatctcttctgcagcattccatatttgtttttcctctgcttcactatacaataccgttgtaaaaaccaatgtccaaagtaggaaaaatttgagtaaattccgacacttattttatgcagttctatctttatgagatttcatcaacatcataatacttaaaatcccggaagcaggcacttcctcctgtttcctctgccgcatagcagaacagaccaaaccggcaaccagtaaaatgatccagtttgaagtacagcttatgcacggttccgatgggtagccagtctcccttatttacccggtaatagcagcgtgcttcatccttcatgttacagaaatctgcttcaagacgaaaatccatctggtgtgattcaacaacagttccttccgtcatatccaatataccatcttcttttttatccagcataaggacttcatattttccatgatgttttgtaatgccaactgcagcataacagccctgcaacgcacacaaacctgctacatcgccctctttcaatgcagaagcatcaacagtaacctcggctgcgcaggacggataactcatcctttgcgtaagcgtatttactgcctgtgtaagctctgtacaaacttcccgtgttgtaattgtataggttccctgcaatgcatccagatgatagtaccgtggatctggatcatgattaaactgccagcgcggaagcagcccattacagaaatcatcacttcccactaatggctgataaatatatcctggtctggtactgtgaacctctatttcttccggcacatgtccgttctgtccaaaaaacggaaaatgatccttccaggtaaccggaagcagaataggaagccgtccaactgctccggaatcctgaaacagcattgcataccactttccatccggcgtatccactattcctccctgtgccacgccctgtccacaatatccacgatcatcacaaagtacatctccacccgtgaattctccttccagagaatcactgtaaaagcatgcttccgtccgcatccagcggtctctcagggaatgaaccagaaaaatataataatagccgtttattttttgaatatgagaaccctcatagcctagctccgggttcttatgatcactgactaaaagacgatgtaatccgtccttctttggtgcagtcaaatcttcattcaattctgtaatccagatttcatcatttccatatacaatatagtttctgccatcctcatcaaataataaagagccgtcatgataaaagccttctatcagctgctttttccatggaccatctattttttccgaagtatacaaataagtcttacgggtatcatttgccacaaagcagatccaaaatcggccttcatgatagcgcagggaagctgcccacatgccctgtccgtaaatattctgaccgcttttcagttgctgcgcatccgtatgatccaacgtctcatagacataagtcgcatgctcccagtgcaccagatcaaaagactgcagaatctcacagcccggcataaagtgcatggttgtggatatcatataataggtgtcttctacgcggatcacgtccggatctggataatctaatcttgttataggatttacattcattgtttattcctttctgttttatctccatattctttctttgttctattctatttttactattttatctttgtttcttatctatacattaacagtagtatgctttttagttgtacgtaaaatgatatgccctagcaccatgactctttaatgacacactaaggctctttggctcttccacgtgctctccgctccaaagctccgttccatttactccatcataaatctccagatcggcaagcggtatggatatgtcactgtctttatcacccagattaaataccgcgacataatatccaccctttgtatctgctgcaatccacaatgcatgctctataccatcgatttcacgtctccacacctgatgcgaatgccgtgcatttgcatgcatggcaagtatttcagaattggttaccagattcatagtgaattcgtcaaaccctgtcagctctcctcccagcatcaaaggagaacgcatgatactccagagtgtcagcatggtgatctgctcatcctgtgtgaaattcgtccagttattcacatcatatacctgccgtatcggtccgaccggaagcatatcggcatccggccagtgccctgcacctgcatgggtgcaccatttttctgctcttgaaaacatatcatataacagttcccacttatcccagaaatcatcggtgattctccacatattggaaatctgcttataaagctctgccttttctaaaagagcaggtcccggcgacagacttaaaaccatgggtcttccgcaaccatgcaatgctttgctcagcataatcagttcggattcctcatgtggcagttcccgtgcaatatcatcacatttaataaaatccacaccccaggaagcatataattcaaaaatactgttatagtattcccgtgccccgtctttctcaggatctacaccatacatatccgtattccaggcacagatactgtttgttttggcaatttcccgggcatgtctgtcactgttcatgattttcgtgttctgatgtacagcctggcgtggaatccctctcataatatgaatgccgaacttcaatccaagagaatggacatattctgccaatggtccaaagcccgcaccgtttgctgcggaaggaaaacgatttgctgcgggaagcagtcttccatactcatccattactacatccgcaaaaggatgatactcattggttgcagcataaggctcataccattggatatccaccacaatatattcccaaccgtactccttcagatgctcagccataaattcagcgttccgtcgtacgatatcttctgtaacagccgctccataacaatcccagctgttccaccccataggtgctgttttcatcttcatctgttttataccctctcgatatcctgttaattctgtccgtaatatgcatttgtaccatgcttacagaaataatgcttatcctgtaattcctgcggggcaggtgctaccagcggatgaatcagctcggttcgatatgccatcttggcaacctcttcaagaaccaccacattgtggacggcctcctttgcatccttgccacaggaaaaaggaccatgattcttgcacaacactgcaggaactgccattacatccttcttcatgcgtttaaattccgaaacaatcaggtgtccggtattttcttcgtaagcagagttaatctcttccttcgtcagacatctcacagaggggatttctccgtagaaataatccgcatgagtcgtaccataacagggaattggatctatgtcaatacttttgacaccaaaagttgaacttttctcccagcataacatatgccgagagaattatttcttaggctgctagagcctcatcttcaacctgttgtggtgtcttgtaatcaagagcactatggcgcctttttcggttgtagaatgactctatatattcaaagagtgctgatttagcctcctcaaatgtgtaatatgtagttgtgtatacttcttccttttttaatacagaatggaaggattcgatgcaggcattatcataggggttacccttcctgctgaatgaatgtagcattccctgatcctgtaagtatttctcgaattcttcactggtatcagtatcattaccttgtcccttgaacacttccatatcagtaaaaaggacatcccctgacctgtaaaatctacagttccggaatgtccttttttccatacttcactatatttttaacacatgatactgcttatccacaatctatatgattccaaaatgtctaaatgcctgcataatcgcatcttccttctccggtgtacactgtggctgtctcgcattctctgatttagccggattgaagttctcaccgacatctaatccacacttcttcttaatctgtgcgatatacagtgatgaaaccttcagtcctgtcttttcaagtacatatgcctttatctgctcataagttgcttttcccttaaattcagataaatccatatcctccagggagaagtcaaccttcacttttctgctgtcggccattctccgttccacttcggtgcgcgctgagcaaaggtccaccggacctttagcgcccttggaaagtaagacaaccgtctcaacggtactttcattttcccaacttatatcatctatcacagtaccattataatatactgggaatctgaagtgtatatgttttagaaacttgccattttcaaggcgttccggataaagctcaatgctttccacgaaggttcccatgaattccttcttctctgcatctgataatttatcatataacttatcaaaggcaattaggaaattgtagattctgtcccctgacaactgctttcttcgaatatgtgccaggcgactctgtatttcatccatatgattttctgtcagagccatttcatcatatttatcataaaaacgcttttgcaggtcatcatatttcttctcatacatggaatctgtcacatcaaggttatccatctggatagctatcttgtcctttgacacctcaagctgcctcattttcttctttaatccatcaagctcttgctccagttcagaggtatcaactctggctgcaatcttctctctgatacccttttcaaagtccggagaagtaaccattttcttaatcagctcagctactgcatcatttacaatatcctgtccccattgcttatggtaatcgcacttatgtcccgtggtcccagtaggatgcttacaggcataatagaaataatctctataagtgccaccttttagatgtctcttacgatttacattaccatacatattggcaccacatcccgggcactttaaaataccggtcaaaatatgttcgtgttcaaggctatgcgtcttaacgcgcttcactcccgtagtttttctcttatcctgagccgccttccattcttctgcactgataattgcttcatgttctccgtctacaaccatgaattcatcttgttttacaacatgaaactcatttctttttccctggaccttctctgtttttcttcttccataggctaatttaccgcagtaaacaggattatcaattacacctttgacaaaggatgccgcaaagccatcaatcgtattattctggcgtttctttttcacataaccgctttcgttgagaaacgcagcaattgctgctactcccatagttgtattgatatatttatcaaagataatttttattacttccacttcatcttccgcaataaataatgatccatctacaagcttatatccatatggagcaaaaccaccattccattttccttctctggccttctgcttacgaccttccatagtctgaacaagaatattgtctctttcaatttctgcaacagctgatagaaccgaaatcataagcttgccggcatccttagaagaatcaatgccatcctcaacacagatcagattgactccgaaatcctgcatcttttgcagtgagctaagtacatcagcggcatttcttccaaaacgagaaagcttaaaaacaagaacatagtcaatatcatctgtgcctgcttcaattagttcaagcatttccttaaactgtggacggccatcaacatttttaccggatttaccttcatcagaaaactctctaactacaaccatgtcctgataatcagcatatttcttaagtttttccttctgagcatctaaactgaacccatcgacctgcatggcagtagatactcttgtatatatgtaacatcgttgctttttcaaataatcactcctccaaaatatatatcaaccattttgccaatgccgacaaaatggttgaatactattgttcctcaatcctattgctgattttttcagcctcatttaggactcgaagttgatactctgcaatctccttcaacgcttcgaatctatctttcttatccattccctctcgaatcatttgtgcgttatgcgattcaagattcgatagaacagttaattcatttattgttgcataatccctaacattactcttttttgcaagctctggattagcctctctccaagcttttgcagtaaaaccaaataatgctacattaagtaaatccgcctcttctgcataaggaagccactgtaaatcctcacgataattgcatacaggaatcaaataattcttaaccgcatccgtttgaattaaataattattcttggatagaaatctctttgcatcccattccaacttctgcaaatcattttcagcttcctttagtctttggaactctttgatcaggtacaatttgaacaccggactgatagcagaagcaaattcaaatgcaatatccttatgcgcaaatgttccgccgtattttccacgtttaacatacagtccaactgcattagttttttctacccattctgatacgcttggtgtaaacgtaacaagtcctgcctcttttttaaagtgttcagattcgaacactttaaaattcggattatatatttcttcccatgttgataagaattccaaagtgcttctatttcttaaccaatttcgaataacatccgcagctcgcgaattatccgatttagcagctgctatatctgtaatacagatatagtcatctatgtcttcatacgataccgtaaccggtattccctgaactgtaataactctattcttagccattattctgttcctccttcgccttattcatctgctctgccttcacataatactcaagcagtcgcagaaagtacttaggaacacgcttctttccatgctcccagtcactaactgtcatatagggaatttcaaagtactcacaaaactgatgcctgttcatgccggtactttcccttagttcaattaaaatatcttttgcgtctctatcatcattcataatataatctgccatatctttgcccctttcacgctaagcgtcaatattatattatcacgcaacatgtgaatattcaagattaagtatataatcctgcctgtctccagacgcattagtccactcatatatcaatgctactttctgcgcggttccaagttctatgctatctccatatttctcaatcattcttgctaaaaaatcacagcagcgattaaagtctccctgctgttgtcttgtcatactaatcattattttcctccgtattttctaattaatgttctaaaaagtccgctcatcttgctcacactgctccatatatatcaggctgagcaacatgagcaggtattttacctatatcagtcaaacggtgttttgccggcaaccggcgtaaactccgctttgcatacattgtgaaagcctcgacgattaccaatacatttcgcatcataaataagtccatatcttttctgattctcctttatataatgcaaaaagccggcagaagccctcggtttttcaaggttatcttcacaccagcttacatagatattataaaaatccgttgatgaaatcttcttcccgatttcaaattgtagataaccttcagacttcataaatgccaggatattatttccctcctcctgtgcatccaccaaattctgcttggcatccacactctccgtaaacacataatggtcctatgtcaagatttagtacaagttaaaatgagaaatttctccccattttagaaaaatatccaaaacttccggttgtgctggtgacggcatacatgaattacgcacgagtaattgatatcgcatatttgtatcagcattcattccgcaatattctctcggtaccacttcatttggaacatattctaatggaatatcatataaatcgaattggtcactggtcaaatcaatatagtggccattgattttattgaagtaatgtgttcctccaccatcaacttttaatttgtaaatcgtgccgtcaaatagatcataaacgagtgatgcagttattgcacattgtccgtatgtagggtcattatcataatcataatctttttgacaacttgggtaagccgtttctttacaccaaacatttaataaaacattaaatagctgatcaattgtgcttatggtgggattatttccatcctgcctttggatatctaatgtatgttctcttccatagtatgaaataaaacgtcctgagtttgttgtaaacatgtcaatacctccaaattagtaaacataaaacttcttttcaatcaatattatttttcccaatcctataattttagttataaaagcaaattttttcctagatgctattaaaagctccaaatcagctttattatcgattctaacatcacttctcccaagacgcctactgctaatagtaagaagcttgtgaagccgattacagctagtaatcctgtctgaagccagtcgccataaacagctatgagaagaatgctaaaaatgattacaaacaagtatactattccgtgtacaatctcatatagtgataccaaagtcttaacaatcagccaaataaaaactaaaaccaatataattggcaataccagtaatttctttaaccctttaagtataatcatagcttttccttcccttacgtcaatttctcttctgaagaagtcgatatggaattattgatgaaagctctggcgaatccggaaatgcgggcgttgcttaattcgctggctaagacaatgaagtaatgaaaagtagtgagtctatctccatcatgcctatagaaattattcaataaaagcgagcaaaacatcaatacaattgtattgaatcagcaatgaaatggcattataatgaagaaaaaaggaggtttctaaaatggcaagtacaattcagatcagggtagacgatgacttaaaaaataaatcagatcagctttttaaagatcttggaactgatacgacatcagcaataaggatgtttttaacgcaggcggttgcatataatggatttccatttgaaataaaacgaactgtgcataatccttatacatctatgacagaagaagagatgcttcaaagactggaacaatccagagaatcttcaaaaaagggaaattaccgaaatgcagatgatgtgatttcagatatgagaggaaaatatggattataaagtagttgtaacagctgaagcagaagaagacttgaaccagtttatacagtatctgctttttgccaagaaaaataagcaggcagccaaaaatgtgcttgatgattttgaggatactattaaaaagttgaagtatgtagcgagtagtttgaatgtatgcgacaatccacgtttacagagccttggatatcgtcgaataaattttcaacagcacagatactttatgttgtacagaatagaaaatgatgttgtatatgtggatgatattttccatgaattacaagattatgaaaaccgaatgatataaattgaatattggcagtaaaaagagtatttaccgtaaaaccgtaaatgctctttttttgcacctatttggaaagaataaataatatagcgtctataaggaagcgttggttttaatggaaatgcattattggaaaatcctctaatttcaaaaataaaaagtagtcgaaatttccatagacaaatacacgctcacgttgtatattataaatataaatctagtcaattaaatatagacatcatttccacctctaagggaatggtagtcataggattgatgtagttagtatcattacatacttccccaaatattagctgtagctaaaaagttgctaacaagctgtacttatctaaggtttatagctgattacagtaattgactggataaaaattgtggtcaagttgaccacaatacaggaaagagaagtattgatgtgatcggagaactttgcggagacagtgcaaagcaggtccactaatgaaaatatgcgaacctttagaaattgtaaaaaaattagcaccgtttaaagtgctaatcttcataatgatatttacatgagtatataatcagattttggatgttatccatatagtaaattaatctatgctcatcggtaatgcgtctgctacatgcttttcggtgctttaatggttctggcttaccaattccggttaaaagcccattgcggtcaatatccttaataagctcattgatccgcttaaccatttttttatcttccctctgccattcggtgtattgctcccaagcagtaggagtaaatactatattcatttattcgtatgcctccaattcttcaatggacttagtaacaaaaccacctgcctcagcctctgccatagatttatcaagcatagcaagatactcagcgtttcgcttggctttcatcatttcgttgtattcagcttcggaaagcataacaatattttcgttcttgggtcttgatataattaatgtttcaccattaaaaaccttatcacataaactcttgaaattatctctaacatccatgctctttactgctaacatataaaacactcctttccgtacataaaaacgtatggttttacgtactttaattatatgctattattatctccatgtcaataaatttaatgtattcactttctggctactttggattttgaatgacagatattgagaaaatgggcgatagaagcaagtgtctacaaattgtctacttgtgaccctttttgtaactgattttgtcaatgccgatattaaccagaccatcaagtcttcttgagcgctccggttctaaatcgtgaagagcacgattgacacagcggcctacagtttcccagtccactctcatgaagtatgatgtggtacttcttggaagataggatgcaaaccatgcaacggtaaggtcgaaatccttggtaaatctactacctggatatgcccatggaacttcggcaacatataccccatgttcaaggcagatgatacgatgcgtctggtattcaacttcgaccagaataccaccccagtccagccccctccaagtggttggtctgctggaatgtttgtcataagcaggacatgacttgtgacagaaagggcagtcattctcatgccatttattaggtctggctttgatacggatgtgtttcacgccatcctcatcagagtaaagattaaaattttctatcaagagaataaagtattgacaaaattttgtggggtggggtagaatgatggtaaaaaattccaaaacataacgcattggcgcttttctcagaaagaagaaaaataaacatgaaaaagagaaagaacttgggaaaaaagttagtaacaatgttagtgtctgtaggcttttttgcagttttgattacagtctttaatttaatggcattacaagctattcgagaaaagaataatgtgcttatagaacagtttgaacaatatgaagaagcagtgaaaaataatgataccgcggtttttgaaacagcaaaaggagaagtggcagaagccatcagacatagcaactacagaataaatggaagcatcatttttgatcttgcacttgtggtagctaatattattgtaatcgtacttctttcgattgttattaataagtccattgttcgtccagcaaaaagagcaaagaatgatttggatgatatcattttaggtatagaatcaggacagggtaatcttacgttaagagtatttgatgaaaccagtgatgaaattggtcagcttgcaaatggtgtcaaccattttattgaaacattacaaaatcttatggtaaagattcagagtgtatcaaaagatatgaaaaaatcttcctatcttgtacaaaatgaggcggaatcttcaaatatgagtgcatccaatgtgagtgcaacatcggaagaacttgcagcatccatggaagaggtatctgcttctctatctgatttagcccaaggatgtaataatctgctggagaaaatggcaggcatgaatgaggatgctaagaactctgcaatgaagttgcatgaagtgaagcttactgcagaaaatagctataaagaagcgattgcatcaaaagaaaaaacagtagaaacatttgatggcattcaaaaggatgtcgcggaggcagtagaagcatctaagtctgtaaatgaaattgcaaaacttacagaaaatatcttaaatatcgcagcacagacaaatcttctagcacttaatgcatcgattgaagcagcaagagcaggggaagcaggcaggggctttgccgttgttgcagatgaaatcagacagcttgcagatagttcacgtgagacagcaaacaatattcaggaaatcagtggaaaagttattgaggcagtaaacaatctgtctggaaatgcaacggaaatgattcgttttgtagatgaaaaggtagcacttgattatgacaaatttgtaaaaattattggaaattatgatgctgattctgatcaggcaagtaatacatttaacgagtttgcagttaagtcaaaagatagcttaggtacaatgaatgatatgaatgaaggtatcaataacatttctatagcgattgaagaatctgcaaaaggtgttacaaacgtagcacaagagatatcacaacttgtaacagcaatttcagcaattacagtgcaggcggacgaaaataagaacctttcggaagatttatcggatgaagtagcaaaatttgaaaaagtttaactaacagatttttattatgagaaaaactgtattaggtaaataacccgcactaactaaaaatgaatgccagaataagcacaaaggcatagccccattacgggttctatgcctttgcgttttccggaagcagcatccggtcgtcgatatagtaatcagaggaaatcttccggctgttgtgtccatagaattcgatgatttccggaagattgtcattaactgcatcaaattcaagattctgttcccggtaccattcgacagcttttgacagggcttcccccgcacggcaagtccagagaatgagtttattgccattacgtttccattcctggagatattcaataccagtgagcgcaaagtttatataccgggatttgtggcacagtgccttattgatataaagaaggaacaggatgaggtaaaggaggcgcttggcagtgagtataccgattacaacctgataatggcgactacttttggaatgccgatcaatggcagctatattcgtgaccagatgcagaaagtaattgataaagaagggcttccggatgtggtttttcatagtctgcgccatacaagtgttacatacaagctgaaactgagcggtggagatatcaaagcagtccagggagattccggacatgcacaggcggacatggtaacagaggtatatggccatatcattgatgaggaccggcggaagaatgcagagagaatggagaatgccttttataataaggaaaatcttaatccggatatacatgagcagaaagaggaagaaaataagattaccataccggagggagtagatcctgaactgctgatgaaagtacttggcaatccggagatggcggctttgcttacttctctggcgaagacaatgaaagtataaatatagaagaacgatattgtgtggagtaagaaatctatgcagtatcgtttttttcgtttcttgtgaaaaaatttgtagttatttgtaagaatttgtcgagaagcgccatgtatataatgtaggtaggttttaacatgaccaaagaagaagaaatcagaatgataaacgaaaaactagatttttatgtaatggaggcaagtgatgaggagttcgataccgaagaggtacggaaactcgtgaagcgattagatgaattggatcccataccattgccgtggaaatcggatgaggaagcattgaaagacttctgggattattgtgaagagaggcagagggaagaacgtataatagcagatatgaaaattaaggatgaaaataaggattaagaagtctgtgttttggaaaaattatgtggtaaaatatatatacgagaagtctgtaaatcggaatttgataaaggagtgattgtatgaaaaagatagtatgtatagtaattttgattttagcaattacagggttattgaatggtattagttatttgatttcaggtattagtgcaagaggaataggtggtgtaaattatgggagggttatctttccactattagttggagctattgctgtttattttttaaaaaaggagaagaaaaaatagaaaacttccgggttgagaagtcagagcctttggaaaaagtatgtggtaaaatatatatacgagaagtctataaatcggaagctgtggaggaaaagcattatgaaaaaaattatgtttggtaacagtttaatgctcttaggtattgcaataatgattcttgcaggtttagagctgatatacattggtattatgtgggcgtcttttcttttaatacctgtaggatttattatggctgttatagggttttttagcaaagacagttaaattcaagcttgtagaattaagaaaatcggaatttacggaggagaatattgatgaaactatttttatgttcgcacttttcaagtgtaggaagtctgataaaggaagaaattgaaaataagaaagtcgcatttattccaacagcttcgttgcgtgaaggctacaccggttatgtcggctcggctcgaaaattattcaaaaagttgggagcaatcgtaactgaaattgatatttcaacggaggcttattcaacgatacagtctgtttttgaagatgcagatgtgatatattttaccggtggaaattctttctttcttatggaccaactccgtaaaacaagaactgatgggttgctgaaaaaggaattggcaaatggaaaattgatgatcggcgagtcggcaggcgcaattatatgcgctccaagcatccaatatatcgagcaaatggatgaaaagccggaggactactcacaagaagatgatgcagggcttgatttgcttgatttctatgttcttccgcattatcttacagcaccatttaagaaagttaccgagaaaataatgactgagttttcggatttgaatctatgccctattaacaaccatcagggaattgtaattgatggtgaaggttcaaaggttatttgcaaagactaatttgaaaaatccttttttgaaactggaaaatcggaagctgaggagatagactattgagaacatatgagaataaagacgagcttaaaaacgagataaataaaagctttgcaaagtatatttcagaatttaatgatattccggagcatttaaaagataagagaattgatgaggtcgatcgaactccggcagaaaatcttgcttatcaggttggctggacaactcttgttattaaatgggaatcagacgaaagaaagggtattcctgtcaaaactccttcggataattttaagtggaatcagcttggcgaattatatcaatggttcacagatacatatgctcagctgtcactgcaagaattgaaaaacagattgaatgagaatatcaactctatttatgtaatgattgattctctgagtgaggaagaattatttaaaccacatatgagaaaatgggctgacgaagcaactaaaacagctgtctgggaagtatacaaattcatacatgttaatacagttgctccgttcggaacctttagaaccaagattagaaaatggaaaaagattgcactataacttcaagtttgccaactttccctttgagaaagaagtgctgaaaaaagccgggaaaaaggatataatcaccatcagtatagaggaggaatagaccatggaagagagaaaactgacctgtattggctgccccatgggatgtcagcttcaggtcataataaaggatgggatagtggaaaaagttacgggaaatacctgtaaaagaggagcagattatggaaagaaagaggtgaccgatccaaccaggatcgtgaccagcacggtacgtgtccagggaggaacacttcctgtggtatccgtaaaaacccggggcgatataccaaagagttctgtgatggattgcgttttggcagagtcctatgtaaaataatcggacaaggatgaaaagaaaaaggagattcttatgggaacaaatgaaaaaaaaatgaccactggatcacctggaaaactgatcattacttttgccataccactgatgcttggaaatatcttacagcagttttatacgatggcagataccatgatcgtcggacaggtggtaggggttgaagcactggcggcagtaggcgccggagactggctggtatggctggtgttcggtatcatgacaggtatcacacagggtttttctattctggtagctcagttttatggagcaagggaaaaagaaaatctgaaatgcgcggtggcgaaaagctatatcatgacagcactgctttctgtgattgtacttgcggtaagtgaaggggcagtttatcatgttcttttgtttttacagacaccggataatgtcattgacctgacaatgctatatcttcggctgatctttgccggaattccgatcatagcggcttataatatatttgcagcgattcttcgagcactgggtaacagcagatctccactgatagcaatgaccgtagcagcgttgatcaatgtgggactggacctgttatttgtggcagtttttggctggggtgtagccggagcagcagtggcgacagtcatcgcacagggagtttcagccctgtactgtctgatggtgttacggaaaattccggatatccgactggaaaaacaggacttctatagacagccggcaatgagtctgcggcttttgaaagtggcgactcctcttgcaatccagaatgtgatcatctctgtaggggggcttacagtacagtatgtagtcaatggatttggattcctgtttgtggctggatttacagcatcaaacaaattatatggagttttagagatggctgccgtttcatacggatatgcaattacaacctatgtaggccagaatcttggtgcaaagaaatatcagagaatccggaaaggtgtgcatagcggaacttatatggcattgcttacttctgttgtgatctcaggtgtgatggtgttattcggacgcaatatattgtcactgtttgtatccggcgaaccggaacagatccgacaggtgttagacattgcatataaatatttgtttattatggcaatttttctatgggtactgtatctgctgtatgtatatcgttcggcgattcagggtctgggtaataccctgattcccctcgccagtggcattgcagaatttgtgatgcgtgtcagtgttgcattattgttaccaaaactgatcggtgaagacggaattttttatgcggaaatttgtgcctggaccagcgcagctgttttattatttataagttatatgattattatacgaaaatacaaagattcatcggattcatcggaactcccggcaaaaggcttataaagatgcgctggcagtggtaaaatatatttcataggatgaatgcgaagaaaaacttcttgcaaatcagcaggtaattaagacgccgattgtcagaaatggtaggaagaatgggctgtgttttctcaactatcgaagataatcatattcatcatattaacaatatgatggagctggggggtgcggaaatctcaggaattaaacttcatgcggcaattgatgtgttgatcagaagaaatcatattcatcataacaccatgggtatttggcttgactgggaagcgcagggagctcgaattacacaaaatctgttacatgataatgatgttccggaaggttctattaagttagaaggcggtatggaaagccaggatatctttatcgaagtaggtcatggaccgactttgattgataataatattttgttgtctagatatggtctccgtcttgcaacagaaggtgtggcggttgtacataatcttattcttggttccaccacagtggttggagccggaacagattgggaagtggatggaagaagtcagcgtcgttacacaccatatcacatcagacataggacagaagttgctgggatgatgaccattcttcatggtgataatagattctataacaatatatttgtacagtattatccggttgataataatgaatcaaaggaatctccgtattatcaggttgtaggcaatcatgtgtgggatgaatacccgacatatgatgaatggattgctagatttgatatggatgtagagaaaccggatatggataagctggcggtgccgcattttgatcatctgccaatctgggcaaatggtaatgcataccttatgggtgctaaagcatggaaaaaagaaacagataagtttgtagatgccgatacggaagttacagtagagcttgtggaaaaagatggattctatgagctggaaacaaatatctacgaaatactcggagattattctaatggtattataacaagtgacattttgggtaaagcttttgagccggaacagcgttttgaggaaagagacgaatcggatattatctttaatgtggatttttatggaaatcacagaggagtatctactattccaggacctttggcgaagtaatgactataaagatttgaaaaaattagagtcctatattgattattaaaaatgaagtacccgctttcattagcaaaataatagtctaatgaaagagggtatatttgtgattaaaagaatttataaggattttatcattgcatttttaaattctcgcggtgaaataccttttacttttttgaaggagcggttaaaggaagaaacactgttaaatccacattcaaaagcaatatcgatatatttcttgttttcagtcataaacatggattttgccaatcggattctttctttagagaatttcaaagggatgatataaataaagttgcagatatatggttggatacaaatataaaggcacataattttatccccgccgaatactggaaaagcaatttcagatcagtaaaagaagcgttgttactagcagaggtttatgtgtatgagtatgatacagaaatacagggttttatagggttaaatgatgaatatgttgagggcatttttgtttctggtgaaatgcaatcgcagggtataggtaaaattctgctgaattatgcaaaggataaaaggaataagttgcacttgaacgtataccaaaagaacgcacgggcaatatctttttataagagagaaggatttgagattcagcatagtggcttagatgaggctaccggagaaaaagattatgtaatgacatggcaatacaaatagaaattccagcttgtagaattaagaaaatcgaaattttacgaagtattgtagtaatatatatttgtggaacgggaggtgtattcatgaagaacattgatatacatggtatgaccaatatggaacttattcgtggaggaatcgccgaatggtactgggcaacggactatattcacggcgatctctatgaggcagaagaactattccgacagggacaccttgtgcggagcaaccgtttgtatcttatccattacccagacggcatgatttatgagcctgtgcattctgcagacggacaatatcttggcacaccagtgtatgatggcagttctgttgtgctactggtagtgagctttacagagagtgttatccgcatcatgaggttcttgcatcaacaagtggaagtacaggaagtagcgcggctaccgttatctgcagtgaaggactgctacaatctgatgcttcatacatcaccgttatcgctgactcgacagccaaatgacggtacattcgagattatctggccagaacatgtacgattcgcaatcaatgatagagaagcgcttaatttccgtgatggagacaaactttacttcaatgtttggtatgaagacccagactatcgtgaagaaacggtggtgcgttctctgcatgacggcacgattctggaaaggtttccgggggatattcgtattatgccgaacggggaaagatggcttataaaatagtttttgacgaaaaattattgtcatgtctaaaaattagtatttgcagaattgatagagaagaaacatataaaacaataaatatggtcaaaaaatcatcgacatccgacctacagcacgttataatatagttaatctaataagaaaaccaagtgatcattgttacgaagctgaatcgtaatggtggccaactgagtgaactcgatggaacggaatggttatatcctccgggtgctccgagcaccggacgagcaccgaaaggtgctttacagagatgaaaacaggttttcttattttgacagggagtaacagaatagttaggaaaaccaaggatttccttgacttaggttgactaatcattgtatgtatttacagtggtatctcgagctcctaagactctattgtaggttcgattcctataggagacgctcatttttagcggtaatgaagatagtttcattgccgcttttttcatgcagaattgtaatttcagtgacaaatttgtcagcgaaacaaggctgaaaatactgattttgtcagcggggatggatgcttgtcaccaattcacactttcctagccgtcacccagagggattaactacagtgtaggatgagttttagggtgtaaaattaggaaaagcagtgaaacaaaacactatattcttgtctgtgatatcaggcctgtcggaagagtccgttcagattagataaatacaatctattctggacgggcttttttgcgttcagagaaaggaagttgcctatggaagaaaagaaggaattgctggatcaggatgaaagagttgtagagattgagctggaaagacttcggggatttgtaaaccatgcttttgattccatataggtattgaataagaggtactgatatgaatatacagatatttggaaaaaagaaatgcaattgcatatggcgcatacataataatctccattccgccgccaagcggcggcacaaatagtaacgaaagtgttttacgcctttaagctttcgtgctacaattaactcaattattaaggcatcccggcatcaatatcagatgcacccacccgttttactgttgatgtgcaggtgcgcctcttttcttaggtgggaataccattaaataggttcactatgtgagccttctttttgtgtctaatccacgttttttgcttgatttactttctttcacactaaaacctccagaataagtagtgttaataattccatctacctattcggaggtgcattagcgtcataattccggttgcggaagagactggaaaatgttattcttatcataggcagtggagccttcttagttcagttgtttcgtgtggtaacttaacaataacggattatgaaaagtaattccactgctttttaataagaataaaactgcgccacagccttggcaggccatcgcgcagcgattttgttcaatcgaaagttgtggaggtgaaatgaatatgatgatgttcttaaaattaagaaatatctgagttcatagaactatgttaaatagttttatgtataggcagaacccgaaaaactatttaataaaggagattgtgcaatgatatttcaagataatgtaatcaaagagtacttaaaaaatgtttattttataacgggaacaccttgtggaggaaagacaaccgtttcacgtgcgttggcggaaaagtatggatttgaactatttgatgttgatgagagattcgacgagcacaaaaaaatgtcgaacccattatttcagcctgcgatgaatacgtattttaacagtgcagatgaattttttggaagaacagttgaagaatataagaattggctgttgaataatactcgtgaacagttagagtttgttcttcttgatttgattcgtttatcagaaaataagaaagttttgtgcgattgtcatcttacagttgctcaggcactcgctttttctgaaccagcgagagttgtttttctcataaaagacccatctaatcttgttgatgaatatggtaatcgaccagatcatcagggattttttcagtacttaaattcagcgactgatatagaaaaagccaaacaaactgtgaatattaccttatatgaactcaatgtaaatcgcatagaggagattaaaagcagttctttcttttggatagagagaactgtggatagtacagttgagagtacattaacttgtgtcgaaaaacatttaggtttaatatagttgaagaaagacattcgattatagcacattttgtttaatgaattagtgccacaaattgagaagtattcttgatttgtggcatcttaataaggtagaataaaggaataaaaagaatcttaattctgttaaacgctattgacaactttcagtttattgggaaggcgcagagaacgaaaaatcgatatttgtggaggtaaagagtgtatgaaaaaggaactgcgtattctggttattttaattgctgtgttattggtaggaacagtaggttactatttcatgccaaagaaattcggtaagaatgtaaatccttctgaggtagaccatataaatgtgttcgatggaaatacaggaactggttttactatcaccgattcagaagatatcgaatatatagtggcgaatattcaaggtatttcaatgaaaagagatggcatttcacttggaagaacaggatacagttttaaaattagttatataaacagcaacgataaagatatcatacctgtatttattctcaatagtgatagtacaatttgtaaagatccatttttctatagatgtgatggtggattatgctttgattacttaaaagcatgtgaagagaaatatagaactaatgtaacagaatctatagaagaaaaataacttattgctgataaatgttttgatggggcgatggtttttacattgataataatggtaattattttattggttttgatacctgtaggaattgttgtagataaaaagattgaagcttattttgaaaataaaagagaaccttaaattcaagtttgtaaggaacagaaactttgaagttggaggatacacgcatgaaaattgtaatcattaatggaagtgccagaaaaggaaacacgctgacagcaatcaatgcatttataaaaggagcatcagaaaagaatgaaattgaaatcattgaacctgacaaactcaacattgcaccatgcaagggatgtggtgtctgtcaatgctctaagggatgcgtcgataaggatgatacaaatcctacaattgataaaattgctgccgcagatatgattctttttgctacaccagtttattggtggggaatgtcagcacaattgaaacttatcattgataagtgctactgccgtggattgcagttaaaaaataaaaaagttggcacgattgttgtaggcggttctccagtagacagtatccagtatgagctgattgataagcagtttgactgtatggcaaaatatctttcatgggatatgcttttcaaaaaatcatattacgcaacagctagagatgaacttgaaaaaaacaaggattccatgaacgaacttgaggggatcggaaaaaatttataaagcacgttccaaattccagctctacaagcagtccttcatctctattgattcaaagaacacaggaaagtgaagcgtaattttaactatgaaaaagagtctgagaatgacagagggaagtatctcccaaaagatcattttttttgcaattccattgtttctgggaaatctgttccagcaattgtataatactgctgattccctgatcgtaggaaattttctaggaagtaatgcactggcggcagtcagttcatctggaaatctgatttttctgatggtaggttttattaacggcattgccatgggtgcaggtgttgttattgcacgatattacggagccaaaaaaagagactgcctgaaaaaggcaatccatacaacggttgcatttggacttgtggccggtgctgtgctgacagttttgggaatgtttctggcaccaaagatcctggtattgatgggaactcctgcggacgtgctcccggaatctattgtgtatttccgtacatattttgcagggtctatgggtgttgtcatgtacaatatctttgttggagttctgcagtcggtcggtgatggacgccatcctctgatatatctgattatttcttcctgtgtcaatgtcgttctggatattttctttatcgcaggtcttggcatgggagtcggatcagcagcacttgcaaccgcaatttcacagtttgtcagtgcactgctctgtatggttcatctgctgcgtgtggaagaagaatatcgtctggaattgcgagagattcgttttgacagttctatgctgaagcagatcatccagaatggtgtaccatccggttttcagaattcagtgatcgcgatcgcgaacgtctttgtacagtcaaatataaatgcatttggaaaaatggcgatggcaggatgtggttcctactccaagatagagggattcgcctttttgccggtgacctgttttacaatggctctgacaacctttgtcagtcagaatctgggtgcaaaacagtatgaccgggcgaaaaagggagcaagatttggagttctctgctcgattactattgcagagttgatcggtattatcatatatgtggcagcaccggtactgatcacagcgtttaacagagatcctgatgttgtacattatggagtcatgcagtccagaacaattgcgttattttattgtctgctggcgttttctcattgcatcgcagcaatacttcgtggatcaggtaacgcatccgttccgatgatcgttatgctctgtgactggtgtttgtttcgcgtaagctacattactgtggcagttcgtattctcccggatatacgagtgattttctgggcatacccattgacttggggtatcagctccgtgatttttctgtatctgttcttacgtggaaaatgggtttacggattcgagaaatcctaatcgctataccgaataatcgcacaaaattttctttacattttcgatttttacaggctttgcaaggtgagcattcattcccgtttacaatcgccattccaagtccaattttttcctttttgaattcatcacttgacattgtatcaaagactacctgcttttctatgaaaagatagttaattggttatcaactgcatagaaatgttaaaatacacataaaatagtaatggatattgattaaataaatcctagatgatataatttaattactaaaaagcgtgtaaatttacaaaaacaaggagttaaactcatggagattaaaagagatgcataccttgaacagttaaagataagaaaagataatgggatgataaagattattacgggaatcaggagatgtgggaaatcattcctgttatttgtattgtttaagaaatatttattggagagtggtgtagataatgaccatatcattgagattgctttggatggcattgaaaatgaggagctgagagatccaaagaagtgttaccagcatattaaagagcgggtggaagatgaccagaaatattatctgcttttggacgaagtacaatttatgtcacgatttgaggaagtgctgaatagcctgcttcgaatcagcaatattgatgtatatgtgactggaagtaactctaagtttttatccagcgatattgtaactgaatttagaggcagaggagatgagataagaatatatccgttgtccttcgcagagttctatgcggctttcgatggagattatgatgatgcttgggaggaatatatgatatatggtggtttaccacaggtgctacagttttctgtggaacgccaaaaggctgagtatctaaaaaacattttcacaaatgtttatattaaggatgttgtagaacgaaacaagctacgaaatgttgatgagattgatactttagtagatatccttgcttctgcgataggagctcctactaacccaactaaaatatcaaatacgtttaaaagtgaacgaggcatcaattacagcaataagaccatatccaaccatatagattatcttgtagaggcatttttgatttctaaagttgacagatatgatattaaaggtagaaaatatgtgggagcaaatctgaaatactatttttcagatgtgggacttagaaatgcaagattgaattttagacagcaggaacctactcatatcatggaaaatattgtttacaatgagctgcttatcagaggttataatgtggatgttggtattgtagaggcgtatgcgaaaaatgatgaaggaaaaacaactcgaaagcagtttgaagttgattttgtggtcaatcaggggagtcagagatattatattcaggtggcttatgatatgacctctgaggaaaagcagaagcaggaatttaattcatttagaaatatccctgattcatttaaaaagatcgtggtagtaaacggaacaaaaaagccttggagaaatgaggaaggctttgtaatcatgggaatgaagtattttctgctcaatgcggatagtttggagttttagaaatattgctgggatatcgccaatgaaaagtaattatagatagtttacttgactttgcaagtgaaattaagcaaaaagagatagaccgcgtagtattcaaaacggagcagcttcacagatttttccctgtcagttacacagcagagcagatgaggcgtgaaattttggaaatgttgaaattaaatatgaacaaatattgggatgaataaagcagctaccgaaacactatttccggatatttcgattaatcttctcaaactcccttcctcccagggtattgtgggtgagaagtcttttgttgcttcccgctgatgcatttttccggtattgtccaggggtacagccgttatgctgacggaactgtctgcagaaatgctctacattattataaccacattgctcggaaatgtcgcggatggagtattcgctgtactctaataaatcctgtgcacggcgcagacgtccttcgatgacattgtccatgcaggaggagccaaattggcggtgatagagagcctgaagatgactgggacttaagtgaagcttcgcagccatcatgtttatattccatggaagctgaggattattgtagatcatcttatgcaatgcaatcagctcatgatcgtgaatacccggggactcattctggattccttctcttaatttggagaacagaacccgcagcaggtgagtaatgtttgcttcgctttcagaggagaaaaaggcggactcccaggttagtaatttaaaaagctgatgacagtattccggatctgttactggaaatggggtgtttgttaacggaaacagcttcacgaaggagtgatcggaacgaaaacgaatccagtcattccggtattcttcaccggcagcacggtaataaatcctgcttcctggtgtatacagaatagcagaattggcggctgtccgcatgagtcttccgtctatgagcagctccgagggagagtcgaaaagaagcagaagatagcctgtaaagccattcggaacatcatatataaaatctgaggggtgaacggcactgtagccgacaaattcaatttcagtcatctggaatctccgttctgatacatcagaggatatatcaattttcttatagtataaatcattggaaactttagatcaatgcgatagtatcagattaatatggcaatcgtcatcagagagctgcggatcgtgcagcggtcagacatctgatgcgtgactgcataggaacatgatttagaagaaggagatacatgcatggtaaatatgggtgaagcaacagagaatgacagaaaaaagatcgtgattagaaaggattcaaaggccttttttcacaataatgtagattattgtgtgggaaccggaagaatggggcttgcattgacagaagaatatcaggaggagctgcgcctggttcaaaaggaaatcggatttaagcatatccggggacatggattattctgtgatgatatggcgatctttcagacctatgaggaggatggtaaggtaagggtcgagtacaactatacttatctggatagagtaatggatgcctataagaaggtggggctgagaccttttcttgaactgggttttatgcctaaaaagttggcaagtggaagccagactatcttttactggcagggaaataccactcctccaaaagattatgatatgtggtgtaatatggtgcattcattgctgcggcatctgatggaacgctatggagaagaggaagttattcaatggcccattgaagtatggaacgagcccaatctttgtggcttctgggaaaatgcggatatgcaggaatattttaagctgttccatagaacctttgatgccataaaggaagtgaatccgggattccgtgtaggaggccctgctgtttgtggaggaacggatgagaaatggattcaggcatttatggaatattgccatgagaatcacatacctgtggatttcgtaaccagacatcattacaccattgatccgccggaatgtattggacattatgcatattctgaactgatgaaggcagaggacggctttgccaatttaaaaacaaccagagatattattgacagtttcccggaatataagggtctgcagattcatatcacggagttcaacagctcctatactcctcagggcgtcattcatgatacaaacctgaatgcggcccttatagcacagcagctttccagattgggagatgtgaatgaatcctattcctactggacatttggtgatgtgtttgaagagctgggagttccttttacaccattccacggcggctttggactggttgccaatggctgtattaccaagccgaccttctggacatttgctttttacaaaaagcttgaggaaagtgaagccaattgtgtatataaggatgacaatattgtcgttttgaaacgtgcaaacggtgattatctaggtgtagcctggaatattgcccgtaaaagtacagaacagggtaaagaaaaaatgctgttggagtttacatttccggctgaacaggaggagtactgcttcctgactaagacggtagatgaggaaacatgtaatcccttgaaggtatggcatgatatgggagaacctgccaatctgagtgaggaacagacgaagctgattcgggaatcatccagaccttttgtaaaaacagagcgtaaaaagcaggaggacggaaatatctgcgtagagcttcctgtaaacgaaaacggtgtggtttatttcgaactgaatgccggaaaggtgaatcaggatcgaggatatgactatgatcgtgtggtcagcttgaaggcttaaactagcacccagtaatttgctttatgaaacaatgtacatggattaggcttgcaaaggaggatatcaaagtgaaaaaacaagcgtttaacccatatttaccgtcctgggagtatattccggacggagaaccttatgtttttggcgatcgcgtatatgtttacggatcccatgattactttaacggatatgttttctgcatgggagactatgtgtgctggtcagctccggtcgatgacctgggcaactggagatatgagggtgtgatttatccgaagacagccgatccgctgaacccggaaggcaaaatgtgtctgtatgccccggatgttacggtgggaccggacggaaggtactatctttattacgtgttggacaaggtttcggtagtttcagttgctgtatgtgatactccggcaggaaagtatgaattttatggctatgttcattatgaagatggcacacgtctgggcgaaaaggaaggtgatgagccccagtttgacccgggggttctgacggaaggagatgtgacatatctttataccggattttgcggaaaaggtgataaatcccgtaccggagctatggctacggtgttgggagcagatatgctgacgatcagggaagctccggtgtttgtggcccctggctgtgaatatggtgccggtaccggatttgagggacatgagttttttgaggcaccttccatccgtaaagtaggtgacacctattattttgtctattcatccatattaatgcacgaattatgttatgccaccagcaagaatcctactagggactttgtctatggcggagttattgtcagcaattgtgatttgcacatcgatacctacaagccggcagatatgccaacagcttacggtgccaataatcacggaagtattgtgcagatcggagaggactggtacattttttatcacaggcataccaataatacctggtacagcagacagggatgtgctgaaaagctgcagattatgccggacggcagtattccacaggtaaaaattacctcctgcggtttaaatggaggtccgcttgagggtaaaggcgaataccccgcttatcttgcatgtaatctgtttaccgataccccatcagtttatgtgggcgaagggaattttccacgagtaatgcaggacggcagggatggagacgaagaagttggatatattgccaatattacagattcaactaccatcggcttcaaatattttgactgccatgatattcgtgaaatcagtatttggatccggggctatgcagatggcacttttgaagtaaagacagcatgggatggagaggtactggcgacattagaggttcaatataccaatgtctgggaaaagtataccgcaccggttacgattccggatggaatacaggcgctttacctgacctatcgcggtaacggaaatgctgcattaagatcatttgagttatcataatctatgttattgcatatacaggcagtgatcaaaactctaagaatgtaaaaaaggagactacaatgagcaagttaaagattaaaacaaaggaaagacgatttgagacagccagggatttatacggaatcttttttgaagacattaaccgtgccggagacggaggactttatccggaaatgcttcgaaacagaagcttcgaagattccgttttaccggagggttatatacagcaggaggatggcgtccatgtaaaaaccgtatccggatggctggatgagttttgcaacggagaaggcttatgccgctgggtaaagggcaaccatattccggaaacagaaataccggcatggtatacacacaatgcaaagatggaactggaactgacggataccctgaatgaacatcgggacgcagctctgcgtatgcagtttgaaaaggacggatctctgactaataccggttactgcggtatatccgtaaaggctggagaaagttactctttgtatttatttgcaaaagcaaaggaagaaataggactggacgtagcgatcgaataccagggaaaagtactggctggaaacagtctggtggtttccggtcaggagtatacaagatatgacatgaagctgacagcagctgaggattgtcacgaggcacagcttactatttcctgcaaagaaggcggagaggttctgctgggatttatttcactaatgcctgacaatacctacatggggcatggactcagaacagatcttgtagaaaagcttaagggaatgagtccaaagtttatgcgttttcccggaggctgtattgtggaaggaacgacaccgtccacagcgatgagatttcgggatacggtaggtccggcatgggaaagacccagtaagctgtttgtatggcattacagaagtacattaggacttggctttcatgaatatctgcagctttgcgaggatctggggatggagcccctgtatgtatgtaactgcggaatgacctgtcagggaagaaagagtgtccttctggaaggagaggctcttgatgaaatggtacaggatacactggatgccattgaatatgctatcggctctaaggaaagcaaatggggaaggcttcgtgcttctatggggcatccggaaccctttaaaatgacctatctggaaattggtaatgaaaactggggtccggattatgaaaagcgatacaacatgatttataagaaggtaaaggaactgtatccccagattaaaaccatagccaatgagcatgtagagaaaaatggttgtcctgccgagtgcgtggatgaacatttttacagtacgacagagttctttgcagaacgtgtaaattattatgatgactacgatcgtaagggaccaaaaatctttgtaggagaggtggctgtaaacgaaggcaactatatgggacagttgtatgcggctttgggagaagcggctttccttatgggtattgagaaaaatcaggatatcgtaacattggcctcttatgctccattatttgaaaatgtaaattacagagcgtggtatcctaatctgattcgtttcaataatcatcagagccttggaattccttcttattatgtctggaaaatgttcggtcaaaatcgcggagaatatgtggtgcgatccgaagatgagggaggacgtgtttatcgtccgagaaccggaatggcatctttaaaatccaataaggaacttcgcttcagaaatcccatttggaatggagaagaagcaaagattactcatgaattaatgggacatgtgcaggatacagaggatggctgcctgcttcagcttccggatgaggagcagaaaaaggaatttcacagtattctggaatgggctgatgagaccaagagctttgtggtatttggagaagaagaccagacttatggaagatttgagaccgatatttttgttgaggaaaatgcttacttcgagttgggtatattcagtgccagggtggttcgttcctattatgaggagcagctcgtgattacggccggagtggaaaaagaatgggatgcagctctggtgcgtccgttcctttggaaggttaatggaggacaatgttcactggaagagtttggctatatgcatgacaacaagctgactgaggattttgctatttcagtaaaaccgggagaatatcaccgctttggatatgaaacggatggaaaacagattcgcctgtatgttgatggtgagcttcagaaggaaatttcgattccctacggacctgcttttgtttcggtagtaactgacaccaaggacgaaatcattattaaggcggttaattttgcaggagatgtggatccggtttccattacactggactgtcaggtacagggcgactataccgtaacacttcttagcggtgaaaagggggatgaaaacagctttgaagagccggagaaggtgaagaatattaccgtgaatatgcatggcgcttcctcagagttcgtatacgaggcaccggcatattctgtcagtgttttgcgattgaagaagtgcgaagcgttttagaggttgacgctgaacagaagataagagaatagaaagacaaaacgggcaccgagaactaaatctatccaagcactcaaggaaattgctttaaaacaaatacaggtattaactgaaatagaaaccgaccactcgaataaatagaatggccagtgcagtttcagatgatttttaaagggaattgatttctttctctaattggcaaaccgattccataatagtattgaagcttggaatatcgccatataacatatctttcatgacttcataatcactgatgagggcaggaaagcggtattccggtggaatcagctttaaggtgccgggaattgcttccggatatttagcccatgctcttggataaaatttcattttgaaatcaacgactgttttcagaaggtttatgtgagaaaaagcaacatcttttactggggtctgagccattctatagagatcatagtaatgtctggaatatcgttgtggcatatccagatgttccggtctgttggcttcgtgatgaagaattgttgccttttcccaaaaggtacgctctggtgaaacggtaagaatttcagtatttttttgctcgaagatttttgggtagtatacagctgtatatggttcaatgcttgcaagcttagcaggtgtccaggctgctaatgctccgatttccaggcggattacctgtagggtagaaggatttgtgaacagatttggataagcgaaaataacagtctgtttgtcattctcatctatgtaaatattagcgtcacacctcagttctaatgacagttccttttttatggtaggacagaactgttctgcaagaaaaatctcagcccggttattagcttctttattaaatgcatcctgttttgtattggatcgtttttcccagggttccagttttccatagcccagtacgcgccagtcaaggattaaatcaatgtcttctgaaaaacggctgatcagattaaacgcttttgaaaggcttgttccacctttaaaggtgatggagtccttccaaggacagcggtgaaacaaataatccagggtaaagcatacccagaagtctttttctacaatagcatcatttaagcccattttatcagcggtatttcggaagagttctctccggtcatcatctggcagacatgcaatttttctcatagtgtattgcctccgcatatttgtcgtattgtatcataaacccagtcggtggattccgttgcttctttcagacaagcctgtttttctgagaaagagagttttgttgaaagagtctggataacttccggggttacattatttttccctaaggttttcaatgcctgaattgtcagacttgtcatataggacagaccggtaacttctttattggttcggtgtttgaattcaagttttgtagaattccattcataggttttataaggtccgtcactaatataggaccaaacagctgttacctgagtggaaagtccaagtaaattaagggcagtgtttccacatggagcgatggtccaatgataactgcgggctaatgcctgtgcaacggaagcaggatcagcagctacatattcatcgagtaatttactgtattttggtttttcataaattccatttataattctgcgaagaataccaacttttgtcaggcgattaagattacgtctgatagtttctgtatctgcaatatcagcaaaatcagaatttacaaaaatgcttccttcaggtgattcatgaattcgcagctgaatttgttttgaataaccatttgccatagaaaacctccttttgtcctgaatattatatattattcgggacaaaatttcaatataatcaattaagattaaaattagtgttccgtttataaatattttgattcattgaaaaaagtctattcagaatatactttttgtctattgtttggggaacgatttttactccgtgtttatctacaataattcttgtaaagaagagtaaacgaaagcgatttacgagaaacaggaggagattatagatgacagaaaagaacctgatcaaaatatatgtgaatgcaacgtcagcaaaaagagtggacatcattatcagacatgaaagtacactttgtctgaaaatgattggaagcacaggaatgaaatatatgatagaatatagaaaaagcattgaatatgtaaatagtaagttataagagaaaatatgacagatagatgttatagtttcgtgtgtggaatacggttgtattccgtatattagatacccagttgcgtttcattatatttctttactgtcggaaaatatgttgaacattaaacatattgctacacttcgcttcaagatgagtgtggcatttgttgtttacaagctttgtgataagaacaggctttcgacagtttatattgaagagtttttgaataaaatacaggagcatgatttcaattcaaagctgttctgcgttttgaatgaacacggcattaatgagaaaaaatttttcgatagtacaattacaaatatagtcattgatgaattagaaaaattctatagtatactgtctagagaagaggatagtgacaaagtagaaaatcagccaagcgactaactgcttttggatgaatgacttttatttagttaatgatactctcatccaaacactgaacagtgatacatctgccgggaatatttttcggcattcaaatccaattttttccagtctcttgcaccaacaatcctgtttctctgctacggtgccacgatggctgtagatctttcccaagtctttaccggaaaaaacggcaatcttttaccgccctttttatggatggtaatctgcctcgtcctctgggttctcgccaattatatctttgccgtgatctcacacctgcgcgcttcatttccggcagttcttctgctctccgtgcgcctgatggcaggtcacatcaaagaaactttcatcttattatttacaatggccggcgcctgcctcatcgtcttcctggttcccggacttttcatcctttttcccggaatcctctgcggcatcgccagccatctgattgagcctggtttaaaaaaggctcttgctattgattaatccagttctttatagtcaaaactgcggaattctgctgtctgatcgtatccggagtagtccacgcatgccatgccgacaaatgctccggtgaagaatccaccgtatgactggagtacgtaatcatcggacaatacagcggcatccagtgtgcccggaatctctgtatagttctttccgtcaaaggaatactcgtagctgtaagactgctttcttacttttgtgcgaagccatacaaattcaacatcatccggtaccggaatcgcatcgtcgcgaaggaacgaacgatatccgccacgattgcactctgccacttcgatcacgcggccatttttctcattccacgtaacgaaagcgaatgaccagtgcttatcattgtaaaaatttgtcaatccagccatctgctgatagttgaacggatcaaatttcactttcacttcggcatcaaagttaaatgcctgccagcgttttgccaccaacgaaagctcatgcttattgctgagggatccttttccaaccaatgtcagcctgccatcccctgtcgtacccatttcctcggtaaatggtacgcggagggtattccactcatcatgaagttttggtgtgtcaaattcatcatgcatcgaatgatctgccggtgcttctgtcaagattgcatctttcggcgcatccacaagcacttttccgccatgtccgccctcgatacgaggccagccttcttcatcccagtatactttctgaattgccgtctcacggccaagcggacaccagccgcgtgggtcgatcgaactttcattttcgtggttccacggtcttccacacaaacttgcataataccactcaccgccgggagtctctacgagagcaccatgtccctgcttctggatctcaagttccggcgtatcaaagtttgtaataaacggatcgccaggctctgtctcaaaactcaacgcatctaacgtctttgaacgagctactacttcctgatgtgtccaaacggttccaccctgtgcagcaaacagataataatatccgttgatcttatacaaatgtggtccctcaaccagtttaacgtccgttccggcgtagatcgtacgtgctgtctccggttttaatttcattgtctctgtgtcaaattctgtcactgtaataccgtcaaaagcatggtggtattcgcgatgatcccatgtctgctgaacaaggtatttgcgtccgtcatcatcatggaacaacgatgcgtcaaatcccacaccattgacacggatcggatccgaccatggtccgcggatatcttctgccgtcgtcagataattgatcatatctttgaacggtccttcggttacttttacatccgtataaatcagccagaattttccatctgcataggaaagatccggcgcccagatacctcccgatgacggatttcctttcatatcaagcaatgtcgtcgtggacaatgcggatggaagaagattccaatgtactaaatcttttgactcgtgcagacgaactcccggaaaccactcaaacgtagagttcgcaatgtaatatgtatcatccacacggataatggatggatctgcattaaatcccggcaaaaccggatttttaatctgcaacataactgtatgcctccttactgttaatctatctctatcatacaggaaaatgggggggttgcaaagggaaaaagaagaatttattcatcctctgcctgagcaagcatggaagtagctgcctgctgcaagatgctctctttcgagaatcttgtcatctcatctgccatatcagtatcacggatacgggattcagcggactgcaggttctcagatgtgttgttatcgactttgacagtgtactcaagacggttctgaatcaatgtcacttacaggtcatttttatacatgttctgataaaattttatgcggtcttggaagaatgtatgccagtggaggagaacttacggaaaatatttatctaggaaaaaatacaatattaacatgaatatcatgaatataatattggaggctgtgaatattcccaaatacttccctctcagattcctgttttcttttgcaatatatttgaaacttatcaggcttgccatggatgcaatcagagtgccgagacctccaatattggttccgacaattaaagcccggtaattatctgtaaagccggataaaagaagcgcagcgggaacattgctcataatctgactggcaagaacagcagtaagtgtttcccttcctgccatgattctttccagaaaactgctgaattgcggaatccttccaaggttgccgataaaaataaataatgcgataaaggtggcaagcagggagtaatccaccctgcttatattttccctgtttcttagcagcatatatataagaaccaatacaagaggaatctggtatggaatgatacgtgcaacagtgagcaggcagattgtaaataagatcaggtaagcggccaggtattccatgttaagttcttttctgtcagagaatcccaaaagagttttatctttttcggaaccgcatacgtgaggtgctttggcagcggctacctgtatccatatcagaagaaggataagtgctgtggcggaatagggaagcatcagggttattaattctgccgcggacatccctgctctggcatatagataaaggttctgcggatttccgattggtgtgagcatgcttccgagattagcagcgattgtctgcatggctactattttaagaagccagtaattgcccagttcctttggcagtttatgcacaatgatcagtgcaagaggaacaaaagtaatcaatgccacatcattggtgatcaccattgacaggaagaaacataagagtaccaacagcctgatcacacccacagttcccgatgttcccatcagcaattttttggcaagtatatcaaaaacaccaacagccttcaaaccagctacaattgccatcaaacagaagaggagcccgagagtcctgaaatcgatataagtaaaataagccttatccggtctgacccagaacatagaaagaagcgccaggatcactgcaattgacaaaacggtttctttcctgaaaaaaacatataatttttgtaacataatatttcctttccggtctgatacgaccgcgtataagtatatcacagaaacatccagaaaaaaaagaatctaaatttcaaaacactgaatctgtatgcatgatgagaaggacgtttttgacgtctgctcttgacatgcccgaaatcatgtcgtatatatatagtaagagctggaagcacaaatttagcgcttccagctcaatcattatcatagaagattattatttacagacttttcttcatagtctttaaattttagttgtgcacattttaatgcgcgaagtttgagtcaataatttacaaaagaagggaaaactattatggaaaagatcaaaaagtgtatagctaacttaaaggttgaaggaaaattaaaagtatatcaaatgacagtgcttgttatgacattatttttagtgttggtggcactgatctcgacagtagtgatccgttcaaatatagagaagatcacgaaggtctggtctccgtcattggaatatctgcaggatttagagacaatgactgcgaaatacagaatcaaacagtatcagcatctggtagaatcagatgcagcagtcatgaactcctgcgaagaagaaatcaagaagctggagagtcagatccaggataccgatgcgaagctggaggcaatcatgtctgcaaacagcaaagctcaaaaaggacaggacgattacgaagtagcaaacgctgcatgggaaaaatacaggggtgcttcagatgaaattctgcagttgagccgtgaaggtaaacagcaggaagcatcgaaactgatgaccggagaggtgtatgaagactataagtcattttctaagaaattaactatattatgtggcaagttccaggtagaattagatcaggcaaagaccatggctaatgtatgcactgtaatcatatttattgtgatcgtggcagcgggtcttgcgattgctgtagtgacgacaatgatcggaaggatcattaccaattccattaccgagccggtagaacagatagatgcagcagttgccagcctgcgtaagggcgaactgtctaatgtagaaatgcttacctatgagtctgaggatgagtttggcgataccatcaggaatctgaaagaagccatgggtattctggcagattatgtcagcgagatctctgtggaggtaaaggcaatcgcgcagggtgacctgaccagaaatggtgatgatattacagatttcctaggcgatttctcggaattgaagacatcactgctgtatattctgaaacggtttaacagtaccctgaccgagatcagcaatctggcagaacaggtatcatcgaattcatccgaggtggaaaatgcatcaaaatccctggcggatggtgcaacagagcaggcaggagttatcgaggaactgaatgccaccattgatacggttgtggatatggctgaagatacagcgaaagaaacacagaacgcatcggcacgtgtaaaagcctctgcaaacaaagcgaacgaagaaaaagaaaagatgaacgagctgctcacggaaatggagcacattacagaaatctccaaggagatcggtaatattatcacagatatcgaggatattgcttcccagaccaacctgttatccctgaatgcttccattgaagctgccagagcaggagaagcaggaaaaggctttgcggtggttgcagatcagatcggcaagctggcagcagacagtgcaaaatctgctgtaaatacaagagatctgatcgataagaccttagtggaaatcgaaaagggcaatacgattacaagaacaacagcagacgcattcaatcagatcattacagatatggagtcctttgcagagcttgcagagaacaccatggagaaagccaactcccaggcagagtccttggagcagatcggccagggaattgaacagctgtccggcgtggtacagggcaatgcagcatcctcagaagagaatactgcgatcagtattaatctggcagagggagcagccaagatgcatgaccgtgtgaatatctttaagctattctagaaaatggcaggaatagagtggagctgtcggaaggaaggttcttgttgtgattgatgatatatttaaagtgtttggagagcagacaggagaaatcttatttgagatcattaaagattgtatggatgattacctgtatatatttgatctgcagaatgatacctttgagatttcacagtcagctgtggaacggtttaatatgtcgaaaaatgttctgacagatgctgcaaatgaagttatgaaggtagtatatgaggaagaccgcaggatgcttgcaaagcatcttgcggatatatgcgaaggaagagaaaatgtacataatcttcattacaggtggcttgataaagaaggtatgccggtctggattaacagccgtggtatcgtgatcattgatcagcagggaaaggcagagtatctgatcgggtgtctgaatgagaccggcaacaggagaagagccgataatgtcacaggactgcttggcggtccggaattccttgcttacctgcgtgcacaaaaagaacccattaccaagggattttttatgcatgtaggaattgatgattttggagcgatcaatagctccaggggagctgattatggtaattatatcctgagaagcgtagccggctgtatgaaggaatgcctttcagacaagcagagaatttaccatctggtagcggatcagtatgtgatcgtggatctggaagcttcctccgcagaagacgctgtggcactgaaagaaaagattacagataaacttcgtaatttcatagtagccgaaaattatgaagctatattttctatttctattggtgttatagatgcagcaacattttgtgagggaaccgaagaatgccgcaaaaagtttgaatttgccttgaaacaggcaaaaagcatgggtaaaaatggattctatatttttgaccaggatgactatgaggtctttttacgaaaaggaagaatcatagcaacacttcgtaatgctattgtaaaccattatgatggctttgaagtatactaccagccgatcgtggactgtcagtccgaacagatcattggagcagaggcactgatgcgtttttccatgataacggaagaagggcgggagtttgtttcaccgatggagtttatcccattattggaagagaccggattgatcattcccgctggaagatatattttgaacgaagctgcagcaatgtgctgtgaaatgcagaaatatattcctgacttccggatgaatgtaaatgtatcctatgttcagatcctgcaaggcaatgtggagcgggatattctggatgcaattcaaaaatattcattacagacggaatgcttatgtgttgaaatgacagaaagcggatttatggatatgacaccttcgttctgtaaattccgtaaaactctggacaagaacgggattccctttgtgatcgatgattttggaacaggatattcgaatcttcattgtattcgtgatatgaatccaagttacgtgaaaatggatagggattttactgccaaggcgatgaacagtgacagggattatgaattatataaaaatatcatccccatggtacattgtattaacgtcaggatatgcgcagaaggcatcgaggaaaaagaatggcttctgaaaatgaaagaaatgaaggttgattatctgcagggatattattttggaagaccatgcggaaaagaacagtttctgcagcaatatgccagtggcatcaacattaaataaagagagtaaggcagactcagctatgtggggctgccttattttatggtcttatcagaaggatggatccataacggcttctttcagtttttccaggtcattggcatcagggtgagacaatgcacagtcaaaattttggatcaatacatcaagatttgccggatgatcaggagcttccgaaaatagatatcactgccaccaaagcctgcagttccaaacagaaaaatctgttgattgataatgaggcatatgcaaaggtgattttaaaacagacaagttattattcactgattggtggatataaggatatctttaagaacccaaccactaaaaaatataaggatgggacaaggtttgaagatcttgtggaactgtattattttgacgaattgttaagacagctattcttagagaagcttgaaacactgcaggagtgcaaagatctggaatgggagcttatggaaaatgagaatgtgtatctgaagctggtatgggaaaaggtccagtcggagcttaaagcaaagaaaacggaaattgccggggcagagccggaagcggagaagatgaaaacggatgcggatgttcctgatgcagtggcaggatttaaggaaagaaccaatgaaaaatttcacagaatagacggtctgggtccggcagatatagaaagccaggtgcatgattatgtaatggataagataagagacaacggtcttgatgcagagataatctatgtggcagtgacaggaaccagaagcaggggaatagaaaataaaaactctgatatagatgtggctgtggagtataaaggcagcatcagggaggatgacttctttgatatgcttcatgaagacggcatgacaatagcaggaataaagctggacatcaacccgatcacggaaggaaagacaggcaccatggaaaactatcttccggcagtggaaaagcatcttgagcataaagcaagcgacagggaaaagaaaaaatcagtccttaaaggcataaaagaaaagtgtgcaggtgcgaaaaagtcagaaccggcaaagaagaaaatgaaggaccacagcagcccttgcgttatattttatacggatattactggaattcaaaataaaaataacgactattactgttattgaaaaaaaaaaaattatcatgtataatacaagcatagaaaactaagaaaaaaaacattgaaaagaaaaaatatgaatgtgaacaatgtggctatatttatgaaccagcagtaggcaatctaaacatagatatcgctcccaaaattacatttgaggatattccagagcattgggtatgcccaatctatggatttggaaaagatgtttttgttcctttagaagagtaagcagaaaatttagatgtgaaactgacagacacaaaaagaatccaagagaaaataaaaaagaaatggagaccagattatgacttatgatttaaatattacttttgatgacaatttaataacaggaaataaaacaattgatacacagcataaagaattgattgaacgtatccagaactttgtaactgcatgtcaaaatggcgacagcaagctaaaagcaatcaaaatgctggattatctggatgagtatactaactttcatttcaaagaagaggaaaagcttcaggaaaatgctggttatccagagtatgaaaaacatcacgaaaaacatgaagagtttaaaaagacaattcaggaactgcaagaataccttcaggattatgaaggaccaacagaacagtttagtgaacttgtacagaaaaatgtaatcgattggctatttggacacattaaaacatatgaccgctctgtagcagaatttatctttatgagagagaatccagaccgatactaaaataaaacagggaaagctttccatcatgattcagacaaagtggcgaatgttcctatgatagataacacttgaaaatactatgtcaatgctaataaaattacaaatgaacaagaagcctatttaacaggaatagttggaaatgatatttttcaatatatgtatatgctatggatatcatatacatatatttatcatacaaattcatgtaaaaataatgcccatatctgtacaggcttattactcatttggtgatttattagaaaatattttgcaagtttttaacagctaaatttatgttttcaaaattgacaaaaatacaaacagttcgtaaaataacacttttatgaactgttttttcatatttacagcattctatttatatacgaatttcacgtcaaattaaaagtgtactggtaaagaagcttctacagccataagtgttactatctctcagaagatatattaatgagaattggataatatataaagctcttaagaagaagcatgcactgttttgtacaaaaaagcataagttaatgagaaataatagtattaaaaaaataattagcaggtgtattatgatgttaacaagaaaatatggaggtatataatgaaggcgcataaatactggtcacttggagctttagtttccataatcggaactttttataccggatataaagggttaagagaagcacacaaatactttgcgtttggctctctgatatgcatgattatggctatatattccggtcataaactaattgctggaaataaaaagacaataaaacatactgattttacggaagtggagaaataattgatgttagaggtgggaacaaaggcaccggattttgaattaccggatcagaatgaagaaatgcataagttaagtgattatgcaggtaaaaaagtaattttatatttttatccaaaagataatacagccggatgcactaagcaggcatgtggcttttcagagagatatcctcaatttacagaaaaaggagcagttattcttggggttagcaaggattctatagcttctcacaagaaatttgaggaaaaatacggactggcatttactcttttagcagatccggagcgcaaagtcattgaagcatatgatgtatggaaagaaaagaaaaactatggaaaagtctctatgggggtggtaagaacaacgtatcttatcaatgaacagggagttatcattaaagccaatgataaagtcaaagcagcaaatgaccctgagaatatgcttaaggaattagattaatgaagataatattatcccctgctaaaaagatgattacagatactgacagcatagcaccggatggattgccagaatttattgataaaacattagagatacaaagttggctgagttgtaagtccaaagaagaactgaagactatctggaaatgcaggcaaaggtcgaaataggagatgcaaaaaatctgtatgagtactggcatgatatgctgtatcgttcagtaattgatgaaagcagaattataattaatcttgcatcaaaggaatattctaaatgtatagaaaagtatcttacaccgaaggataaatatattacaatttcattctgcgaacaagctggaaataaactggtaacaaaaggtacttatttaaacctgattttttgcatttctttgaaaataaaggataatattaaatttttaaaataggaatgattactgttttacattgactaaaatactataatactatataataattatggttaattaatcctaattaataagaataaatggctatttagagaataccatttaaaatacatggagaagataaagggacgaaaatatggataggaaagcaatgtataagctgagttatggattgtttatactgactgcaagggaagacgaaaaagacaatggatgtattattaatacagctatacaggcagcttcggaaccaaaccagttaagtatctgtgtaaataaggcaaattatacgcatgatatgattcaaagaaccggaaaatttactgtatcagtcttaagtcagaaggcacaatttgaattgttcaaacattttggcttccaatcaggaagagataccaataagtttgaagcatttgagcagtgtgccaggggcacgaatggtatttattatattacagaaggaacaaatgcatacatttctgtaacagttaataaaactgaagatttaggttcacatacaatgtttatcggggagataaccgatatggaagtaataagtaatattccttcagctacatatgattattaccagaataacattaagcctaagccggaggatgttggcaaagcagaggatggtcagacaatatggcgttgcagaatctgtggatacgaatatgtgggagaagaactgccggatgattttatatgtcctttatgtaagcacccagcatcagattttgaaaaagttgtaaagaaaacggaggtaaaataaatggcagataacaaatacgcaggaacacagacagagaaaaatttacaggaggcatttgccggagaatcccaggcaagaaataaatatacatattttgcatctgtagcatagaaggaaggctacgagcagatgtcagcattgtttttaaagactgcagataatgagaaagaacctgcaaagatgtggttcaaggaattagcaggaattggtgatacaaaggaaaacctggcggcagcggcagaaggcgaaaattatgagtggacagatatgtatgatggctttgctaaaacagctgaggaagaagtatatgcatattgtaacctgcatggattatggaaatgctaaaagcatttatacatattaaggttaaagaacaacacaaatataacagtaatataggctgtgtattaatatatttacaaggaggaacaacgaatgaaatacgtatgtgatgtttgcggatgggaatacgatgaggagaagggctatccagaaggtggtattgcacctggtacaaagtgggaggatattccagaagattttgaatgtccgttatgctttgtaggaaaagaccagttctcagaagcataaatgtattatgataggattataccaatgaaagaagaactaagaatagatattgtcggacttgcaggagcctgttcctatgctttggactgtatagaagcagagttggtaaaaatcaaaaacaagcatgggaaaagagtggcttatataagtgtatgcatggctgaatatctggcaattcaaggtgatgcgttacaagatttagctatgtgtgccttactgcatgataatgctttgacacaatatattacggaagagctggaaaggaattatgttattgacattaaaaaagatttgtccgtaagaaaaacgaatcttcattgtatttatggtgaaaaaaatattactaaacttccttttaaaacagatgtctcaaatgtgattttgtatcatcatgaacatgccgatggaactggtccttttcaaaaaaagtggaatgaaaccccattgcctgcaagaattattcatcttgcagataccgttgatatcataggaaatagtattaaatctgatgataatagatgggattttatatgtcagtatctttcccaaaaaaaggatagtctatttgattcagaatgtgttaatgcttttcttcatgtattcacaaaagaatcctttatgtgtttaagtgatgattcttttgaaacgaagctatgggaaattattccaagagaaaaaatggtttttgattgggaaatgtgtaaaaatgttgcggatttctttgcaaagattgtagattataaatcttcttttacaagcaggcattctataggagtagctgaaaaagcctccctgcttgccaaatatatgggatatgattcaatcacggtacagaaaatgtatttggctggtgcactgcatgatataggaaaaatggcggtaggcaatgaaattctggaaaaaccggataagcttacggatgatgaattttctacaatgaaaaatcatgctggttatacatacctcatattatcggaggttaatgattttgaagaaatacgagattgggcggctttccatcatgaaaaactaaatggaaaagggtatccttttggaaaaaccgctgatgaattaaatgagcaggaacgtatgatggcatgtgttgatatttatcaggctcttacggaagacagaccttataaaaagggattgtcccatgaaaaaacatgtgatatccttgatgacatggcacataaagattttattgattcagatatttcaaagacaattagagaatgttttggaagaacctgatgccatatatgaaaacagagggtgtttcagacaatagtattttcagttatgtactagtatgactcttacgagggaaccaccggcacgacattccagattacatcacgttcgatcggagaggtaactgtagaaaaaattggtaaaagtgctgtatttttcgggggggggggtacaacattttatgtgaaaaatagaataataaaattgttcccgaaatttattgactttgagaaaaaaatttgatatatcagaatcgaacaaaagagaaaggaaatagcaaactatgccgacaaagaaaaatatgatgaaaaagaacttggaaaatttgcatctgaaggaaaggataaactatggctacagaaaagtcattattatgatgttagtctcaggtctgttttctattgtggttataggtatgctatttgccaatacgatgcattatgtacaaaatgttactgttgcagaccgggcggtgaaaatctgcaggataaatgttaactcatcagcgagaaatatcagggaaatggcattaaataatgatacatcctcttatgacggttatgagcagacggtagaaagactgcttgcagaagttaatacccaactgaaaaatttaaagaactccggagttattccggatgcggattgtgaagaatacgcatctgcccttacagactggggaaacattggttattccatcatgaaagaaatcaaaagcggtgacaaggataaggcagttgattcaattctgaatgattgtaccccggcattaaataaagccgtaaaaattgcaacaagattagatgaaatgaccgatgaggtaagcagccaggcagtcagaattacggttatttctgcagtggcaggaattgtgtgtattattatttgtctggttttggcatggaaactggcaataaaaacaggcaaaaaagtacttgagtcaattttagtaccattacgtgaagtggaagccgttgcacaggaattaacagatggaaacctgcacagcacgctggactaccattcagatgatgagattggaatactggcacacaatatgcgcaaatccatccgcattctgggaagctatgtagatgatattggacgttcaatgaagatgtttgcagaaggaaattttgatgtgcagccggaagtagagtggaaaggggatttcgttggaattctaaactcctttatgttgtttgaagaaagcatggcagagacaataaagggaatccaacatgtttcagatgaagtttcgggtgccgcagatcaggtagcatcaagttccaatgaccttgcggatggagcaacaaatcaggcagcagttgtagaagaactgaccgcaacagtcgcaggtgtttctgaacaggtaggaaaaaattcacaatccgcaaaagaaatcagtggaagagtagacgaacttggaaatgccattctggaaagcaatggtaaaatgagggatatggttgattccatgaatgagatcaacggggcatcaaaagagattgacaagatcattgcaacaatcaatgaaattgcgtcccagacgaatctgcttgcattgaatgcttccattgaggctgcaagagcaggggaggcaggaaagggatttgcagtggtagcgaatcaggtcaatgtgctggcagaccagagtgcccaggcagcaaaggaatccgcaacattgattgaaacctctgtgaaagccgtggaaaaaggtatggtgattgcagggcagacggcatcacaattgcaggaggtcgctgagaattcccagatcattacaaaagaagtcacaaatattgcagaaacgttagagacacagacaacagaaatccaacagattaatgatggaattgaacagatcaatgatgtcgtacagacgaattcggcaacatctgaagaatgtgcagcagccagtcaggagatgagcagtgaagcggaaaatctgcgtgaaatgatcaagaaatttaaagttgcagaaaatagaaattaaaaacggtgcaaaaaattatcgatgttgaatttacatataaagttgtcgcaggtaggaactataatttgacttgtgacatatataaatgtgggaaaaggatgcaatgaggaaatgtgcgttattggttttaaactgataacgcacattttaaattatatgaacagtaatatcatcgcaaaaaagcataaaagtagaaaaagttaaaaatatcgtggatatagtgctagaattgttgaaaaaagtaagttaaaatacaggaaaacaacaagtgtaaaggggaaattttatggaatattcagcaatttttcatgatatggataaaaggtttagctatgcggttgataaggatttattcgtgatacgcgtgcaggtaaaaaaggatgatatgaaggaggtaatccttcactatgaggacaagtatatacctatggagcgtaaggataccagaaagacagttccgatgaagaaggttgctgtctcacagtttcatgattattatgaagcacagataaagatgcatttgatctgtctgcgttactttttcgaatttacggacacgcagggagaaaaggtatattatggaaattatgagtttgataaggaatgcattacaaacagggatagaatgtttgactgtccgcagaacctccgggaggaagagatgtttgaggtgccggagtgggcagcaaacaaggtcgtgtatcagattttcccatcccgttttgcagcaacggagccggtagacaaagaactgtggtataaagcaccgattacgcctatggatgatctgcatggaaatctcaggggaatcatcgaacatatggatgatattcagaatctgggaatcgatgtgctgtatatgacacctatctttcaatcaaattcgtgccataagtatgataccacggattactacaagattgacccatcctttggaacaacagaggatctcaaagagctggtacaaaaagcgcatgagcgtggtatgaaggtagtcctggatgcggtatacaatcatacgggaagagaattttttgcgtttgcggatatcctggaaaatggtgaaaaatccaaataccgggactggtattttattgacggattcccacttaaaagcgaatggggagagatcccaaacttcaaatgttttggttattatggcggaatgccaaagttaaacctgaaaaatcctgaagttgaaaaatacattacggatgttgcatgttactggattaaggaatgcgatattgacggatggagactggatgtaggggacgaaatcagccatttcttctggaagaatttcagaaaggcagtcaaggcagtaaagaaagatctgctgatcattggggaaatctggcattatgcaggagatttccttgagggggatgaatgggatacagtcatgaattatccattttacctgaacctgatcgatctgcttgcagacgaaaagattacggtcagccagttcgtacaaaatcttggatatttgaagggacgcttacacaaaaactgctatccccttatgtggaatctgatcgacagccatgataccgcaagatttttacatctgtgtaacgacaataagaaaaagcagcatctggcagccgcttttcagttgttattgccaggaatgcctatgatttattatggagatgagtatgcgatgccgggagcaaacgatccggactgcagacggggtatgtactgggatgaagaataccaggacaaagagatgtatgaatggtacaagcggctgattcaggtccggaaaagccatgcatgcattgtagaaggcgaactggctgggagcgtcacagaagatgaggaagggacagttgtcctgatcagaaaaaatggcgaggagaccattgccatgatttttaactgcagcagcagtgcaaaaaaatttaatgagtacacgcagaagtacaatctgcttaccgaaaacacctttgatggaaatgtagaggggtttgatgctgcagtaatcgtgctttaagaagccttacggcagatggtttcccgggagtttgtctgtgggaagaagagggaaagcaccagtatttctggtaatgtaaagtatggaggatgatatgacgaatgtaaaaaagaagggtggaaaacggtttggggcaattgtacttagcctgatattattgctttccctggtgtttccatatcctgtgatggcagaccagacggcggcagaccagacaacggcagcttccgtttatgccattcacaagacaggtgatgataaggaaaattttgtgattgttatcatgggtgagggctatacccaggaacaacaggaacaatttttaaaggatgcaacggcaaaagcacaggggctgctaaagtggtctccttataaagagtattccgacaggatcaatatttatgcagtacagacggtgtccaatgaaactggtgtgggcgtgatgtatggggagtcgaacccggacacatattttcatgtgcaggcattcggaaaatcctgctattttgcaaaggacggggaagataaagccagggcactgagggcagagctggagagcagatatctggataccggcgcagccgttggaaccatccatatcatttgtaatacgactgcgaatattggttcttcttccaatgcactcttttctttttcggcaaattcggatgagaatgagcagggggatgtcatgacccatgaaatttcccacagcatcggaagattaggcgatgaatatgataaaaagatgcagggagaaaatatttccgacacatcggatccggataagattaaatggcataagatgcttgggttccgtggaatcggaataacggcagcaggaacagaaacagtatttgcgccgagccgcgtctgcatgatgcgggatcttgggaatcctttctgtgaagtgtgtaaaatggaactggcgcggagattaaataaccgtgattatgtcagcaggcaggcatctgtttatgtgtgtgatcctgaaattacaattccgcatagcaggacaggaacacttgacagggatagtgaccaataccggatcgatgagacaaatatcacaaaagcaaatggaaaggatctggaattccgtacagtcgtacaaaatatggtggatgccaaacagcatttgaagattactttccgcattattggagcagaccatacagtcaaatatgaaaaagaagaaacatataccgttccgccactcagtaactggtatgatccggatgctgccagagagtccctttctgtcacacttcctgcggtaactggtctggtttccggggacagactggaaggaaagatcatagatgaggacactgggaaaattctggctgacaatcagacggcaggacaggcgtggagtaccgtaaccattcgttatatgctgcaaaacgaagacgggaccgaaacaacagtgcctgatacggcacccgcgacagtatatgtaccaaagaattctgcgtatacgttaagaagtccggatttatatggatatacatgtgtaggaaacagtgcaaatcagggagaaataaacatcacagaggatcgccaggagatcacttattattaccggaaaaacagtgagatgccggaaatacaaaccgtacctgtccgcgtaacttatgatggaaaaccccatacatttgatatcaaacaggaagatggtgtacaaatcagttacagtttgacagaaaacggatcgtatacacaaacggagatgccgttttacacagaagcaggccagtataaaatttattttaaagcggaaaaggcatcttttattccaatatacggggaggctgtcctggaaatcgaaaaggcttccaccagcatgcagctgactgcaaaaaccgatacggtcaaaggtgcggggacagtagaattacagctttgcagacaggggattccggaagatgccgggataaaagtaacctgtgatgtttccgggatcacattagaagaaaagggaacggatcactggatggcaacgcttccgaatgaaacgaaaacatatacgttcaccgcatgttataatgggaatggcaactatacaggaagtaaggcagattgtcaggtccgtgtaacggcggatcattcccagaccgggggcggttctggtggaagttccggaggcagttcaagtggaggttccggcggaatatccggaggcggttcaagtggaggttctggcggaagttctggtggaagttccggaggcagctccggtggaggttccggagaaaatgccggtggaagcacggacggatcatctggcaatgtttcaccggattccggaacattaccggcaccagatcatgcaaaagaagaaccggggaatgtgacacctccacccgcagcagatacgtccgtttctgttaaggatattaatgtcaaagcaaaatctgcagttaaaaataatacggtcaaagtgaagaatattgcagcagttttgaaaaaagaaattacaaaggcagaaaaagaacagggtggcaggataaaagacctgtctgttgaaataacttttgatacggcaaaagccggaaactggaagaatctgcatcttgaaatggacgggcaggcggtaaatttaattgtcaaaaagaatgtaaaagaattgaaggtcaatggtggcaatgtaaatcttacctttgattcgaaggcattaaaagaattaaagaaagagatgaatacagctgtggttatcaaaatgaaacaggctgacaagaaaaatctttctgccagggcagggaaaattattggaaaacgtccggtttatgatttttccgtcgcaggaataaagaaaaagcagtcgtctgtcctgaaaaagggacggatcagggtcgctgtttcctataatgcttcgaaaaaggaaaaagacaaaaagatttttgcatataaaattgataaatacggtgcagcagttaagataccgggatcttattatgattccgatacaaagaccgttaactttgtaagccgtgggtttttcacagttgcagtaggctgtgaaaaatgatgaaacataaaaaatcatcgttcacgttaaaaaaactgtagttcatgtcgaaaaagacaaaaaccggttttcatttggtataatgatagagctcattttagtaaaaatgagttcatactgtgaatgatggaggggataacaatcatcgttttagaagaaatattaatggcaaacggcttgaccgtgttaatgatgtggttccttttgttttgcagacgaaagaacagagagagccttcatgtgggagataaaatatatgatggaatagcaatcgtaaatttagtgggtgcattgtctgaaaccattgcttttctcgtagatggaaaacagtttactggcagccggcagattaattatatctctaacagcatatgctttatagggacagtcagtatgggtatgctttggtgtatgtacgtggaattgcgtatctatcgaaattataaaagaatggttcaacaagcaggagtggagatatttccctggctggtagaagtaattatggttttatgtaatctgtttggaacagggattatgtttaaaatatccggggagaatgtatatcagagaactgccggtgtgctggtgggatatatttcgcttgtcatatattttgcttacagtatctatctggtgtatcattccaaaaaacaaggggttaacctgaattttttcccggtgatctatttcgttggtccttgttttgcaggtgtagttctccagttccttttttatggaattacatcatcatgggtgctggttgcggtcgcgttgatatttgtgcagatgcagtcatacgcagagagtttgtatatggatgagctttccggattatataatcggagatattttaatgcggtgcttgcggaaaagaaaattgcaagccataaatccttatatggaatcatgatggatgtaaacgatttcaagtgtattaatgacaatttaggtcatagtacgggcgataaggctatttgtacgttgggaaatatactcatcagatccataccggatgatggtatggcaatccggtatgcgggagatgagtttattgtgctgctgtcaggtgttgatacggagcgtgtcttagcgacaatggaggagattaaccataatctgtcccggtttaatgaatccgggatagaaccgtttcatttaagtgtttccatgggatacacggaatttgggacagaagatgatgcagaaacttttttaatgcatatggatgagaaaatgtatgaggaaaaacggaaatatcatatgcgaaagaaatcagccggtttggaaaataaagtatagcattacgttcctgccatttgtccgataactggttgcaatggcacaagaaaagaaaatattataatcatcaaacgagtagcagactggtgtaaatccggttttgctgctcgtttttatatttatggttataggcaaggatgctccggatttcaatacagtaaataaccgtgttatggtaatgtggtatacaatcatgttatgagtgcagatgatttctgtatcaataaatttgttccgggatatttttcccgtatcaaggaagacggttcgtattcaaacggctcaggatgtggaaatgatacagcatccgagagaaacatggtacggaaatatattgtggattccgtatgctactgggcagatgtatttgaatactataagggacttattaagttcagaaaggcacatccggcacttcgattatctacatcagaggatgtgaaaaaatatgtaaaatccatagaaggacttggggataatattgtaggaattaatataaagggcggtcagaaagatgaaagtgcaaaagagatgtatcttctttttaatgcaaacactgacaacgcaaaagttacaattccggaaggaaaatagaaagtctgcataaacggacagaaagctggcgttgagacaatcgagacaatcaagggtggcgagtatacaatggatggtatcagtgcacttgtacttgtaaaacaggatggtgcggccatgacgattgttattgttctgattgcagcagcggtagttgttgcggcaggagttgttattgttgtaatgaaaaagaaaaaaacaaatagataataaagtttataattagtgtctgcttactcagcaggcactaattattttgtatggaatatctgcatggccccataccgtgataaggttaaacatgttaaagaaatagtatcctaaactttggacggtagaggatgctatttttttgcgcgaaaatatatcgaacatttgattgctttttgatcgaaaaatggtaaaataaatacatacagaaagcagtatcaaagcatagtgcggtaggcggtttgcccttattatgagggctatggtgccctctggttgaaaggagggcgatagcatggttacatattctgaactttttcagttttgcatactgattgttgctattatcaatctgatcgtaatgatcttttttaaccataaaaaataaccgcccctaccaaagaccggttattttttaaaactaactttggcaaaccgcctacacggtattgctttttgtattttcataataccattgcgtaatttttttgtcaatgatttaaagatctttgctggataccattaaattgttttattatctgcgaacaatttctaatcgttcgcgctggataagtttttcatactgtctcaattgaaatactgtctacctgtgcacttaaatgattttagacaccagatccatatctattatagagtaagatcagtataagcaaaacgagtatcactatatatctttttttcattattataaataacttgaagcatagaaattggttttactcgaataagtttgcgatgtaatctttacaattcctacatttccaactccaacataagtatcaagatttccagaacattttaaggtaatacaggaggaagtacatgtggttttgttactttgtccagaaagtttatatgtatatataacaaaatcagaatctacgcttgcattagaagcacttgcatttgtccagtgctttccactataatatccaacggcatcacaactatatataatatatagagatgaacattataattcccgcaatttcatttcatttattttctttttgcgcgtaatcgttctatttctttttatccgattataaattgatataacagtaggaatatttgtaagcataaagataatgatacaattgtgtatcttatcctttatagacatctgatttttggaaacgaaactatatgagagtgtcaataacccctgcttctcaacgcgttcaaaactttctggttcaaaattaagatacactataattaatacgattgaaagaacaagaaaaataattggtgttaatgatacggtagttgttcttctttttttatttaaatatgattctaaaaaacgtacacaaataatggttaatgccattattattacgatgaataaaattgtagaaaatttcatttattctcctttttgctctctgtatttttttatcaatatttttgctgtgtcaaaatcaagttgatcatctattaccatttttttaattaatgaaatataagcgtcattttctgtttgatcattcatttgcattttttgtataagtcgatcaagtctcaatcgcacggtaggatatgttatatgatacaattttgcaacctcttttaaagagccagatgacataacaaaattttttataaatgtgatatcttcatcacttaaattgtatatccattcttgcgcttttcgtctcattaccaacccctttctttaacattattgatattatcatttaataatgttaaagtcaactgctaatattatgttatttacatctttttatcttaataatcattcgaaacctcaaactggtaaatataaggttttcagattcgaggttactctcaccccccttgcttttgtttatatttcttcaatcatcagttataaaaaacagaagcattttaatcagttcaccatgtcggtttcatttatattggaagcacaaggtgtagagcagagattgtccgtgtcggtgggtggagcaactaagaaattgtttggtattacagcggaagaacttttgaaaaaagcacggtaaaatgctgacttatcaattgaaaaataattattttgtatggaatatctgcatggccccataagtatgcggcaaatgtggagccgtgacctttctcgacgggcaggaaaaattccggcaggttgcgcacgtattacacaattgcttgagattggcgtgtgttgttgtatccagatgcaggatcagcgttgctgtcttaagcggccggagcatctgcccctcggtaagctggataccatccggggcaagccgcccataaatctgtgggagcaggtcaagggaataggtatctcccagaaaagataattctgcaagatacaggcggctctgacgttctaccacatgtgcaaactcttcataagcctttgacaaaagcatcaggctgatgcagtccacaatgtaagcctcctggatctgttcatggttcagatataattccgacagttcatccactccgtttccaagcgtcacaaacccataggcatagtgaggcagagaaaccccgtctaaatcctgatccagagagtaatacgcataggattcaaccaggggatgaagtgccgtataaattgcctgaatatgaggcaggtcatccggagggaaatggaaacggctgcaaaattcgttccagtcaccggaggataatccgggagtaagtttacatttcatgggatgcatcctccttatcggaagcagccataacggctgcaatttcctgaaagcggcccgtgaccttatcatagttctttcggtgatggggaaagccacagtttatgcaggatttgataccattttttaaatattcacagtttccaccacaggatttcccgagtgtatagaggggacaataacaaaacagacagttaaagtcctcctccggaattcctttatggcatggaaaatattcacattttttattttgaaaaaacttataatattcgctcaaaatggtttcctccaatcaaagcacaatcatagcataattatatcggaacaacaagcggatcgcaagaaatgcgaatgacataaaaattgcatttcagtgggaaatgataccttttgccccttttatcattacattatttacatctttttaagaacgcaggtatagtggctcaggcaattgaggggttgaagcaaaaagttgaaaattaaataaaaaatacttgacttaaagttaactttaaatggtatattatgatagataaaatcggaaggagaatttattatatgtatatcgaaaagattaacggaccagaagatgtgaagaaattaaatatagaagagatgacagctctcgcagaagaaatgcgtcatgcattattaaagagggcaagtattcacggcgggcattttggcccgaattttggcatggtagaggcaatcattgcactgcattatgtttttgagtccccaaaggacaaaatggtatttgatgtttcccatcagacctatccgcacaagatgctgaccggtcgaaaagatgcctatttatatgaagaacattacgatgacgtgacgggatacagctgtccgcaggaaagtgaacatgaccattttacggtcggacatacctctacatccgtcagtctggcatgcggtctggcaaaggcaagggatcttcgtggggaaagtgcaaatgtgatcgcaattatcggagacggttctttaagcggaggagaagccttagaaggaatggattttgcagcagaattagacagcaacatgatcattgtagtaaatgacaatgatatgtcaattgcagaaaaccatggaggactttattcaaatctgaaattactccgcgagacaaacggacaggcagagtgcaatttatttaaagccatgggactagattatgtctatgtggatcatggaaatgacttaagggagctgatcggggctttcaaacaggtaaaagacagtaagaaaccggttgttgtccacattaatacattaaagggaaaaggttataaaccggcagaagagcataaggaagaatggcactggcatcttccgtttgatattgagactggaaaatcccattttccggaagtggaagattattcttcggtgacctgtgaatatctgatcgaaaagatgaaacaggatccgacagttgttgcaattacatccggaaccccgacgattctcggatttacgcaggagaaaaggaaacaggccggccggcagtttgtagatgtgggaatcgcggaggagacagcggtagcacttgcttccggaattgccaaaggtggcggaaagccggtatacggtgtgtattccagctttatccagaggacgtatgaccagatttcacaggatctgtgtattgacgggaatccggcaacgattgttgtgtatacgggatcggtatttggcatgacggatgttacccatctgggactgcaggatattccgatgctttctaatattccgggactggtttatctggcaccgacaacaaaggaagaatatctgtcaatgcttgactggagtgtggagcagaaggaaatgccggttgcgatcaaacttccgggcggagacatgatttcggatggcagagaagtcacaaaagactggagccagctcaacacctatgaggtaacggaaaagggaagcaaaattgcactgatcggactcggaacattttattccctggcactgcagaccgcagaaatgctggagaaaaaaggcattcatgcaacggtaatcaacccgtattatattaccggactggataagggactgctggagaagctgaaggcagaccatgacacggtagttacactggaagatggcatcctgaatggtggtttcggagaaaaaatcgcaagattttatggaagcagtgatatgaaagtctataattacggattgaaaaaagaattccttgaccggtatgatgtaaatgaggtattaaaagagaatcatctgacagcagagcagattgtaaatgacgtattatagaaggcagaaataaacaacaaaccttgtgagaatcgacacaatatggtaaaatataacatactagagcttattttgcatagtggttagaatagcgggctcatggaaggagcggtatcatatgaagaataaagattcgaaagcaaggatgcagatgattttcgggatacttttgtttgcgtttatttttatggcagagttgtatgccatagtcaatttcccgaagatgtttattgttctggttgttttggcagcagcagatctgatatgcctgtatgttgcaatcagaggcgtgatttcagtatatgagacaaaatatgcccggagagaggaacagtatgagagtattttcaagtcggaaaaggcatcatatctcatgctgaaaaaatattttgaggaaatatcggtgaagcttgcatacatggaagaggcatctaagattccgacagaggaaattgtcaatgcacagaagggaatagcgaaagtaattatcaagcggtcccatgagaataccgatgcattgatgaattcatacgaacagctgctggaccggtttgatacgttccagaaaggaatggatgggttcggtacagttgcgggtgtttataaggacgagattctttcagcctgtaaggatgaaatttcttcggtgcagaaggatggaaaagaacaggaacattcacaggataaagagatagccgcaaagctgcaggaaatcattattgcaataaaagatatggaactgcgcctgaatcagaccattatgaacagtcagaaagtggttgtttcccagccgcaggtttctgtacctgtggcaacacctgtagagccacagccggcaccgcagagttatgtggaagaaacaccggtagagccggagatctcaccagagccggaagaaagtatggagccggaaccggagatttcgccggatctggaagaaaacccggaaccggaaattttgccggatctggaggagagcctggaaccggagatttcgctggagccggaagaagatatggaaccggagattctgccggatataccggaagaggaggatttaaagccggaggaagagcctccgatcatggcagcggatgagattattcctccagatccggaagaagccattgaggaagcagaggaactggtagaaccggacccgattccggaggaagcgattgttgatgaagcggatgatgagaacctgccggaggaagaacttccaccgatgccggatctgtcagatccaaaccgttccatgagcccggatgagatagctgcgctgtttgcgaatatgggcaacgataacaatgcggataaagttgaggaacctgccgaggaaactgtggaaccggaggatattccggagccgattgaagagccggaagccgtaaaagaagcaccgcttcagccggaagaaccggcagatcccaataaggcattaagcccggatgagatagctgccctgtttgcaagtatgggaacctgaaaagaataaaataacaggcaacggatgccatctgttccacgtaaaaacgtgtgacagatggcgttttgctataaaaatgccataaaaaaaatagttgcatttctttttcattgtgttatacttaggtcgttgcaatttaatagtttaaagcagagtagacacatgtgcgttaagtgccggatgaacagggagttgtcacccggacgaaaagagaatcttgcggtacatgagtcgcatcccgctgcatccgaagataatattatctccagttgtagtacggtgaggtctgcaaaggaggtaatttttttatgaaaaaattcgttactttgttcaccgattctttccgtgaattaaaagcggtaagaaccatcactaccatggcaatgcttgctgcagttgctgtaattctaggatttttctccattgaatatgggcagtttattcggattggtttttccagtattccaaatggtatcattgattatctgtttggaccggtggttggaggaatttttcatggtgcgttggatattatcaagtatatgatgaagccaaccggaccattttgtccacagctgacgctggttgttatactggccggaatcctgtatggatgctttttttataagaaaaagcttacgatctggcgtgtgctggcagctaaatttgtagttatgctggtctgtaacgtgattctgacaacactttgtctgaacgtgttatatggacaggcatttatggtgcttcttccggcgcgtgcgctgaagaacctgattatgtggccaattgattcggtgatctttttcgcaatcacaaaggccttagaacagattggactctttcgcatgttccagaaacctgtacttgcaaattctgcaaatatgcaggggaattagaaaatttaataagttatagaacaaaagccgtccgcagaaagaaaactgcggacggttttttataaatttatttacggatcggatgggtggcaatattttttaaaatacgaacagcggtctgcataccttccacagagatatgttcatatggaccgtggaaaccgtaaccgccggtaccgagatttggacacggcaatcccataaaggacagtcttgcgccgtctgtaccgccacggatcggacgggagagcggtgtcagaccttcggaggcaattgcctgttttgccagatccacgatttccattttatcttcaatgacagagagcatattctcatacgaatgttcgatgtcgagcgtgacggtttccggtccatatttctgattcatggattgtgcaacgtcacgcagattctgcagccgtttctcaaatgtagttttgtcatggtcacgaatgataaaggaaagggtggcggaagccacatctccggacatatcggtcagatgatagaatccttcccggccgctggtgtgtgccggcgtttccgcttccggaagccgggaaacaatttcacatcccaccagtgccgcattgaccataatgtcttttgcttcgcccggatgaacatttacacctttaatatgaaagatggcacttgcggcattaaagttttcgtaagccacttcgccttcgtaatcaccgtccactgtgtatgcataatctgcctgaaagatagcaagatcaaacagatccgcacctgcgccgacttcttcgtccggcgtaaatccgatccagagttccccgtgtggtgtaccttctgcaatcagttcttccacggctgtcatgatttcggcaacacctgccttgtcatcagcgcccagaagtgtggtaccgtctgtcgtgatcagggttcttccttttaaagaggcaagggatggaaaatcacttacctttaagacatcctgacttccttttaataagatatccccgccatcatagtcgggaatgatctgtggtttgacatcttttccgggaaaatccggggcggtatccatatgagcgataaagccgatggatttacagttttccatgcccggtgtggcaggaagcttggcatatacatagcagtgatcggtgaggagtatattggtaagaccgagagtttccagttcctgctttaaggcttttgcaagcgtgaactcacgctcactgcttggaatgtcactgcaggattcatcggaggttgtccaatagctgacatattttagtaatctttcttctactttcatgttaaattgttcctttcaaatatgtttttaaaaaaatttaaaaaaattaaaaaaagtgcttgcttttttaatactcctattatataataactcttgtcttaaggaaagacacaaaacaaacaacttaaaaatgcgcgattagctcagctggcagagcacctgactcttaatcagggtgtccagggttcgaacccctgatcgcgcactcgcaaagcttattttgattgaatcaaatggcaaaagaactcttgacgaacaatgtgattcgttgggggtttttttattatataaaatgcaaataattatagaaagaaaccatagggggaaatatggagaaagtatatgagtatgcagccgcggttctggcagaggtcaaacgcgcgattgcggggaaggatgcctgtattaccaaagcttttgctacaatacttgcgggagggcatattctgattgaggatgtgccgggagtgggaaagacaacacttgccatcgccttttcgcgcgtcatgggacttttggatcaccgtgtacagtttacaccggacgtgcttccggcagatattgtaggatttaacatgtaccagaaagagacgggacagtttgtgtaccatccgggaacgatcatgtgtaatctgtttcttgcggatgagatcaaccggacttcgccaaagacacagtccgcgcttcttgaggtgatggaggagggcaaagtaacggtggatggtgtgagccgaaaagtgccacagccgtttgttgtcattgcaacacagaatcccaaaggcagtgcgggaacgcagcttcttccggaatcacagctggatcggttcatgacctgcatgagcatggggtacccggatctgcagagtgagatggaaattgcccagggaaaaacgatgacgaaagcggaggatctgcagccggttcttcttccagagcagctgtgggagatgcagcagtatgtggaacagatttatgtgcatgataatgttgcaaaatatatcgtacagctgatggaggctaccagaaaaaatgcttacattgagctgggggtaagtccccgtggcacgatcgcatgcgtgcggctggcaaaagcatgggcatttttgcagggaagaaattatgtgattccggatgatgtgacggatatttttgcggatgtggcaaaacaccgtattgtgctcaacacaaaggcacggatcggacatgtgacagtcgatgccaccctgcaggaaattctgtcggatgtggacaaaccaacaacatacaaaagacttaggggataaacgtgggcagttttctgattggaacaggggtgacgcttgtcacattttatatagcgctgatctatggaagcattgcgattgggctgattgggtttgcggaactggtactgatgctgcttgcatgtttgtatctgctgatttattgcagacatatcacggcagatatcaggattccgcttaccgtggcggaaaaagggaaaaaagttacggtacagcttaccgtggatcagaccatgttgtttccggcagcaaaagtgcgttaccgtgtgcgctgtagaaatacatttgccgggtatgccagaaatttctggtggaacggtgccggactgatgcgcggaatgcagtgcatggaaaagcgtgtcgtgctttctcatgtgggaagttatgagtatgagcttgtaaaagtacggatttatgatttgaccggtcttttttatgtgcataaaaaaataaagagatttgcagatatacaggtgctgccggaactcgatgctgtggcagtacaggtgtcggagcgggtacgcagatatttcggagaggcggaaagctacgatgattttcagccgggaacagatgtcagccagatctttgatgtgcgggaatatcgtccgggggaccgcctgcagcgcatacactggaaactctccgccaaatcggacgggcttctggtgcgggaggacagtcagccgcttgcctgtgcggtggtatttttgctggacatgctgccacagatgtcaggaaaaggccggcatatgaggcgcagcagggaagcctatgcggaaacctttctcacaattgcggcagatctggtgtattcgatgatggatgccggctgcccgcattatgtggcatggcaggaggaaacagaaatcaaacggttgcgcgtcgaggatgaggaaagcgtgtctctgtttttgatgcagtttatggaatgtcagaaggaaacggccggttcactgcgacagagatatgagcagcagtatcgctgcgagcatccggtacacaggctggaactgacaccggagctttttcttgtgctggatggacagacacttgcggattttggtggagataactggagacagaagctggaagaaatggagctggtattgtgaacaggaaggacaggagagggaataaaaccacatatttgtctggcaataccggtatccggctgatctgtgaggcggttgctgtggaactgctgttttatgcaatgcttgcgattttccggagtgcattcggatggcagctgccgatccgtgcgcttggtaaactgcaggtggccatgctggtaagtcttgtgctgtttatcgtgggagttcctgcgaccggaaaatatcagagggtctgcaaggttgtgcttgaaatcggatatccggcggcactcgtactgtttggaatttttcatcggagaaaactgacagagagcggaaaaatgctgtttcaggcatatctgtcatattggaataaacagtatggaacaaattatatgaccggggccgggacggagatgcggtatacttatatgctggcgtttttattggcagttgttgtgctgttaagtctgatgtttcgatatgtgaccggtgtgcggctggttttgctgcttccggatataacagcgttgtcggttgctcttctggtcaatgccagactgggctggagtggaattgcactcttttttgtgggaaccgtgctggtgtctgcggcaccatggacgcacatggatgtaagggtggctgacggtcgtacccatgtatggatgcagctactgtcctatgctgcagccggtgtgtttgccgtgattcttgtctcggtgagcagctatgcgttttccggtgtggcaaagcagattccgaaaaagtcaccgaagttttatgcgtttcagagacaggtggaagaacgtgtgaaaaacctgacgttttcggggataactttgcagggatcgcgggaacatgtggataatacaacaccggactataccggaaaaaccgtattttcgatagaagcatcgaaagccccggcgggcaaactgtatctgaaatcatttgccagtggcacatatcagaacggtacatgggtaaatgaagggaaaacgtttgcgcacgaagtggataaggcgggataccatcgcagtgatgttgcaatgttaatgcagcagaatgccggtgaacttgtaaaatacatccgttcgagtgagctggaagagggtgaaacacagacggtttcgtatcagatttcctatcgggcactggggttaaaaaacgcgtatatgccttatttttcagatttgcagacagccggtgggaaggtctggctcagggatgatacggtggtacgtaaaaagagggcaacgggaaaggtttcttttgagggactggatgaaaatacggatctgcgcgatgtttttgacaggttttgtatggtccacggagaaacagatacggatctgcagcagtggtatgatgcctatgctgacagcagataccgtaaatttgccacggatgttccggcagtgggagattttattacacgaaggctggctctggaaagtatcggatatggcgtgtatgaggaaaacggcacctatgtggcggatcagatggaaacaggcgggttatacgatgaggattggctggcagatacggatggaaacaattccggacgggcagaaagacagataactaccaacaacatccggcagaatcttgcgacacaggttgccaactggctggggaacgaaaatacctataacttatatctgaatcacatcccacaggggaaagataccattgcttattttctggaaaccggacatgagggatattgtatgcattttgccagcgcgggtgcgctgattttacaaagtctgggagttccggcgcgttatgcatcgggatatgtggtggaaccatcggcatttcataaagaaaagaaaggctatcaggcagatgtgccggactacaatgcgcatgcatgggtggaaatttatctggaaaatatcggatgggtgccggtggaaatgactccgggctatacgaatgacagtgcaaagctgccgacgactccggaattgcgcgatacgtggaaacagcggcatgaagagcacaaagatgcggcggagcagaatccgcagacgcaaatgcagacgaaaaacgaatcgccgtcagaaacacagatggaaacacagcagcagacagaaagtcagatgacggagaaggagacaaagcggccggtaaaaaacaatgagaaaaagaacaacaggcgaaatctgcaggtattttctgcggtgagtctgacgctgcttgctgttgttctgatgctggttctggtgacaaaatcgttgcgcatttaccgggaacaattgcttatggagttgcgcaaccggcagaatcgtcatgcggtataccggatcaaccggcggatttaccggggattacatcagcgaagttttggcatgaagaccgatgcggactatctggaaaagctgatgacaacctatccgtccgttccggcggaggattggaagaagtatctgtgcattgtgcagaaagcggtcttttccgaagaagagatttcacaggaagaagcacgattttgttatcggctgtaccggaagtacagaaaccggcggattttgggaaagtaggataacggaaaaaccgcctccttagcgggaggcgatcagtttacatatcgggttacccttagaagaaaatttttcttcgtattcggtcatgatatttccttcattcatggatggatcatggtgcaggtcacgggtggaggcattaagatgccagcggtcggaagtttcgatttcctcgagagaaaacgtaaacagatcctgattgtccgttttaaattccagccgtccgtcggctgcaagaaactggtcatagcggtctaaaaattcatgggaagtcagtcggcgtctggcatggcggtcctttggccacgggtcggaaaaattcagatagatccggtcaacttcttccggtgcaaaaatttccggaagttttgcagcgtcttcacacagaaaatgaacatttggaagctgcagggtatccattttctggactgcgcgcagcagtacactggtgtaacgttcgatgccgatataattgatttcgggatgtaacgcagcaagatccatcagaaatctgccttttcccatgccgatttcgatatggatcggatggtcattttcaaaaaaggcatgccattgtccgcggtgttctgctgcattctgtatacaatatgggctggctgccacagcttcattggcgcccggtatatttcttagtctcatagtaatttctccttggaaaagataaattcagttttgctaactgtaagaatactactactatatacaaatttcgtccgttcggcaaataaaaattgaacgattatggaaataatggtattataaatgtaaaaaaatcaagaattggggagccttatgaaaataaaaaaatacacccgtgtaacagcattttttcttgccgtatgcacggttttactcatgttaccgttgtctgtgcgtgcagatgagtactggccggacggggtaaaaacgcagtccaaaagtgccattgtgatggaagtcaataccggcaccgttttatatgaaaagaagagtcacgacaaacattatccggcgagtatcacaaagatcatgacggttcttctggcaatcgaaaactgtgatatggatgaggtcgttacgttttctgcggatgcggtatttaaaaatgagggagatacttctcatattgcccggaatcttggagaaaaactgacgatggagcagtgtctgtatgcggttatgctggagtctgccaatgaatgtgcttatgcggttgcggagcatgtggggcagaaactgggtggtgattaccggacgtttatcgatctgatgaataagcgcgcaaaggaactgggatgtacggatacgcatttcaataactgtaatggtctgccggatgaagatcactgggtcagcgcgtatgatatggcactgatttccgcagaggcatacaaaaacgagacgttccggatgatcgcaggcagtccaagctatacacttccgaagacaaataaatgcaaggcagaatatccgtgtcacaatcaccataaaatgatctacccgtttcgcggggacagctctcatttgtacaaatactgtactggtggaaaaaccggctacacgacagtggcgaataataccctggtgtcttttgcggagaaagacggaattactctggtgtgtgtggtgatggatgcggcaacaccggatcattatacggataccagaaaattatttgattactgctttgaaaatttccaggcgctgaatatttcggaaaacgatgcgggtctggcaaaggacaacggaaaaaattacggggttttgaacaacagtgaaccttatgtaaagctggacgaggatgcttatatcattatgccaaaaggagcacagttttccgatgtatcctataaaaagacagaatctgcaaaaggaaaaaagaaagttgcaaggcttgcatacacatatgccggtcatgaggtcggcagtgtggatatagtaaaaaccggagcaaaggtaaaagataattattacgtcaataccgatagcgggcagaagaaaaatgaacgtgtcatacggatcgatcctgcatggctcattgttgcgggagtggttattgtcgcagcagtggttctgttgtttctggcaaaacgggcatatgataatttttatgtgatccgtcatcagagaaaaacgaaaaaaaatgataaaatgcgttttcgtgagaagaaacgaaagaaatacaatcgcaggaaggacaggtttttttaaatcgttcaaataaagcgaaaatgcttgcgtatttgccgcaaacaggtataattacaattgatgaatttcattttaataatgaaattggaggttaccatgtcacaatctgttacgataaaaagtaataaatacggaattaatcttgtcttagacccggagattgggtttgatgagttattgaaggatgttgtcgaaaagttcaaagcatccagtacattttttaaaaatgcaaaactggcattgtcctttgaaggaagaaaactttcggaagaggaagaacagcagatcatctcagcaattgaaagcaacacatcgattgaaatcctgtgtatcgttgaaaatggaacaagacaggaagctgtcatgaaagaacaggtcgaggcgttttacgatgccgtacagcagcagtatgagaatgccgcagcaggaaacggaccggagcagttttatcgtggcactttaaggtcgggacaggtgatttcgagtgaatcgagtgtcacgatcattggcgatgtcaatccgggagccaaaattatttcccagggaaacattgtgattcttggggcattaaaaggtaacgcacaggcaggatgtatgggggatcgtaactgttttatttttgcgctggatatgcagccgattcagattcagattggggatctgatcgcaaagagtccggacaagccggaaccgaaacgccgtacactccgtcggtcaaagacaccggaagtggaagcacagatcgccattgcaagagatggaaatatctatattgagccaatcaccaaaaatatattaaataacatttagggacgtaggaggaataagtttcatgagcgaagtaatcgttatcacatcaggaaagggtggtgtaggtaagaccacaaccacagcaaacattggtacaggtcttgcacagttaaacaagaaagttgtaatgattgataccgatatcggactgcgtaacctggatgtggttatgggtctggaaaatcgtattgtatataatctggtagatgttatagaaggaaagtgccgtatccgtcaggctttgatcaaggataagagatatccggaattatgcctgcttccttccgcacagaccagagataaggatgctgtcacaccggagcagatggttgcgctgatcaatgagcttcgcgaagagtttgattatattttattggactgcccggccggtatcgagcagggatttaagaatgcggtagcaggtgcggaccgtgcactggttgttacgacaccggaagtatctgcgatccgtgatgcggatcgtatcgtaggactccttgaggcaaacgagatgaaacggatcgatctgattgtaaaccgtctgcgtgtggatatggtaaaacgcggtgagatgatgacggtagatgatgtaaccgatattctggcagtaaacctgatcggggccgtgccggatgatgagcagatcgttatttccacaaaccgtggtgagccactggttggaaccaactgtctggcagggaaagcatattccaatatttgccaccgtattatgggagaagaagttccattcctgaatctgaatgagaagcagggagtacttgagaagctgaaggacatttttaagaagaattagagggggtacttattgtgggaataatggatttatttaagaagaagacttccggcaacgtcgcaaaggaccgcctgaagctggtgctggtttctgaccgtgccaactgttcttccgagatgatggagatgatgaagaatgacattattgaagtgatctcacgttacatggatattgatgcggaggcgcttgatgtaaaaatcaccgagacagagtccgattccaataacggaacggtaccggcacttgtcgctaatattccgatccgtgatatgaagcatcgtccggacccgagatagaaattacagagtacataagaaaatgcccggcaggttcctacttgccgggcatttttaaaaagcaggtaaccaggagaatttgaaattgcatgacaaatcgttaaaagagttatgtgggcagttatccatatcggctgctaccggccgtaactgggtaaagcttggaaagataactccccaatatataaaaaatggggtgccctattttgatgaaaagcatattgcaatcatagaaaatgaaatccggtcaggaaaaaatgtggcattaaaaagccgcagaaataaaaaatatgtttccggaaatgcgttatatcgttcttatgtttcccaaaactgcaagaaccttaccgttttacagaaactgctctccgagataacacgggaacaaattctgctgacctctgatgtgatatcctattttgtggcagactgtgcgctgcagttattcggacagaaaccattgtttttccaatatctgcaggggaaaatttctatagggaaatatgacatcttactggatgcattgatcggtgacagacaaagggcaatggatttctgtcagaaatatccggcattttttgcacatgaatacatctgggagccgggagaagacattctgggacttatatatctttcctgtaaaaatatgggaagccggaaagcgcgcggttcgtattatacacccacaaaagttgtaaaaaagctgatttctcatctggatatcgaacatataggaaaagtgttggatccgtgctgcggtaccggaaatttcctgcttcagctgccggaaagtgtggatctggcagatatttatggcacggataccgatgcggtgagtatctgtatcgcacgactcaatatggctctgaaatatccggacgcggatgttgaggagatctgcgaacatattacagagaagaattttctcacagaatatgatagaacaggatttgataccatcattggaaatccgccgtggggctatgctttttccaatgaagacaaagcagtgttaaagaccagatatgccacggcttccggaagaaataccgagtcctatgatgtttttatcgaacgggctctggagattcttgttccggatggaacgctggcgtttgtgctgccggaagcggtcttaaatgtaaaggcacatatgcgcatccgcacaattctgcttcagggaagttctgtaaaatcccttacgtttctgggagatatgtttgacggggtacagtgtccctgcatcctgttgcagcttattgcgaccggaaagcctttgtcaacggcaggtatgatcatagaagaccggacacgtacatataccattgctatggagcggacggtagtgccggaaaatttcagttttcggatgacagatgaagagtatcgtgtgctggagaaaataaaaaattccattcccgtctgttatctggccgatcatgcagattttgcacttggcattgttaccggaaacaacaaaaagtttctctccgcagagaaaacggaaaattcggagatggtactgaaaggtacagatatttgcaaataccacataaatccggcaaaacagtatctgcggtttgaaccggagcagtttcagcaggttgcacctctggagatataccgggcaccggaaaaactgttgtaccgttttatcagcaatcagctggtggtggcttatgatgaccggcagatgctttctttgaatagctgcaacattgtgatcccaaagatcgagggaatgcagatcaaatatattctggcaattttaaattccagtgtttctcagtttgtttatcagaaggaattccattctataaaagtattgcgggcgcatatggagcatattccgattccgcgtgttgggaaagcgatacagaatgaaattatagcgatgaccgagccgctgatttgtggaatgggaaaagaggcagcagagacttgccagaaacggctggattgcagaatcatggatttgttccggttatccgcggaggaacagtggatcatccggcatgctttacattaacctataaaggacagaaatgtacaaaaggacaaaaataaagacactaaaccgaaataaagacaaattaaaggcattaaactataaaattaaagcataaacgacattgcaaaattactgctgatttatcagacgatttaataatgaaagcagctgttttttgtcttcggtgtaaattaacagaccattacaggtgcgaacgatggtaagaatctgcccggcaaagagatcactctgttcgaatgtatgcagcagaagttcctgcatatgggagggtacggacaggaaaacggtctctacctgttccattggatggagggagacatttgcatctgcaaataatttcccaaggcattgttcctgttccacctgtgcagctgtcttgtccacaataaaaaatccatcggcatccttcggcatatgcaaagactggacggcgcgctgcacctgtttggtcagggcatccgatgccggatacagagattcaaaataactcataaaatcggcagcttttcgaaagtgccggttttttccgttttgggtaagttcggtcatgagaatccggcgaatgatgctttcgcatgtctcgcgggaaggatttttgcgcagctggtttttctgattcaaaatgggatctcctttgttacagtttcagattatctttactatatactattttcttgacgaattccacaggaaaaggtagaatacgaagtgaaataccacgttaatttttatggagcggaaaatgtcgacaaatacgaaaaagagtaaatcatcagaagaaacattggaaaaactgtgcgcttttattaatgaaaaaggcggcatcgtaaaaaaggaagaatttgcggcacttgatgtggattaccgcaagattctggaatttgtggaagctgggacactggtgcggataaaaaacggttattataccgaccggatcgaccgcttttccgaggaagaactgatcgcacggctgtttccggatgcgcgtctgtgcatggaaagtgcgctctatgcgtatggatatatccgggaaaagccttacggatggcacttagcggtggataaaaatacatccaagtcgcggtttaagatggattatccgaaagtaatcccatactatacagagccggaagctttggaacttggttccacaacgattgagcagaatggactgacgtttcagatttatgataaggaacggatgatctgtgactgcctgaaatatgaggcaaagcttgaccgggcgattttccgggaggcgatccagtcctatatccgggacaatgataaagacatttccatgctgatggaatatgccagagcgcgaaaagtaacaggaaaggtacagagtctgatcggagtgtggctgtaatgaaagtcggtgtatgtgaggcaacagaactgaaaaagagaagcgaaatgctctccattccatttgcggatctcctgtggggatatgcggtggaagatctgatgctgcgtgtcagtacgtctgcataccgtgaatttttatggctgatgagcctgccgcttctgggagaagaagcataccggcaacgcgccaagaagcgcatccgctttttttataagggaagtgaggaagaactcacgccggacaaactgcagcccggtcagcgattatccatcgcaatgggcgaacatatcaaaacaacactttttgcaaaagaaaatgcacagaaaatccattgggaaggtacggtgacggcattgagcggcggaatccggcttagcatgaccgccgggtattttgatatgaaagttccgctgaatattgagatctacagttttggtgcggtcagccagattccgggaaccagggaagaagaactgattgcagtgggaggagacagaaaaatttcctatctggtgtattcgccggagagtgaactgagctatgatctgtttgcgatcatggacaagctggaactgatcggcagcatgggaagttattatgatgcataccggctgctccggacacagccgctcagcgggcgttatgtgctggaggaactgacggtgcttaccgctgcatctccgaagatgcgaaaagagcagagattaaagcagctggacgaataccgggcttacacatatatgcgcaagcgctgggaaaagtatctgcgtaaccatgggctggcagaggttccttgggaagacgcaatcgatctgattctggtgtttgtgtccccgatctgggagagtctttgccgcaatgagatcttttttgatgactggatgccggaacttggccggttcttgggatagggaggaaatatgctggaacaaaaactgaatgaactggaacaatcggacatctatccgtttcatatgccagggcataaacgtgcattcctgccttttgccaatccctatgccattgacattacggaaattgagggatttgacaatcttcaccatgcaaccggaatcctgcaggaggcgcagcagaaagcggcagatctgtatggtgcaaaaaaaacgtattatctggtaaacggaagtacctgcggacttcttgcggcgatcagtgcagcagtcccacggggcgaaaaaatccttatggcgagaaactgtcacaaagcagtatatcacgcgatgtatctgcggcagctggttcctgtttatctgtatccggaagataccgcctacggcatccaggggcaggtaacaccacagatggtgcaaaagcagctaaaacagacaccggatatccgggccgttgtcattacttccccgacatacgacggggtcgtatcggatatcaaaaacattgcggataccgtgcatgcatatgggattccgctgatcgtggatgaagcgcatggagcgcatttcgggttttccccggagtttccggaaaatgccacaaggcttggtgcggatgccgtgattatgagtgtacacaaaacacttcccgcatttacacagaccgcattgctgcatctgtgttccgaccggatcgcggagaaaaaggtcgcacaatttctggggatttatgagacaagttctccgtcgtaccttctgatggcggggattgaaaaaagtctgcagatcatagaaaaagaccgggaaatgctgtttgctgcatacagcagaaggcttgcagagtttcgggataagaccaaaaatctgaaaacactgcaggtattacagccctccgatttttcaaaacaggaggcgttctcatttgatccgggaaaacttctgattctgaccggaaacagcatgagcggacaggcccttcaggagatattgctgcaggaatatggtctgcagatggagatggcaagtggaaactatgtggttgccatgacttccattatggatacggacgaagggtttgcgcgactttcggacgcactggaatgtattgatggaacggttcataagaaggaagagaccagcgagatttcaccgcgggagatttaccgggaacaaaaaaccgtcatgacgatagatcaggcactggacgcagaacaaaaaacggtccggctggaggaagccacaggagaggtgagcggggattatgtgtatctgtatccacccggaattccgattcttgtgcctggcgaagcgattgacgtgcagaccgcagaaacgatccggcattgtatccggctgggcctagaggtagagggactgccggatttgacgtgtataaacgttgtgaaatgacggcaaatatattatactagaggaaagagatcaatgggcaaaatttattgtgtcatgggaaagagttcttccggaaaagacagtatctacagccggattatgcagcaggggaatcctgcacttttacgcattgtaccgtataccacccgcccccgcagggagggagagatggatggcagggaatatgtatttacagatgagacacatgtacagcagctggaaagcgcaggcaaggtgatcgagctgcgggcctatcacacggtctatgggatctggaaatattttacggtagatgatggaagaattgacctgtcggcgcacagttatctgtatattgtgacactggaagggtatcagaaaatacaaagatactttggaagctcacaggtagtgccgatttatatagaagtggaggatggcgagcggctgcttcgggcgattgccagggagcggcagcagaaaactccgcagtatgaggaaatgtgccggagatttcttgcggatgcagccgatttttccgaggaaaagctgacagaggcaggcatcacacgacggtttataaataaggatatggaaggaaccatccgggagatcacggaatatatccggcgggatatgtccgggatggagaaacaggataagaggatttctatatggcgataaaagtaaacgatatatccgcggtcaatcaggtaccggaggccacaaaaacagtagaaggcgacggctcgttcaagtttacacttgcaagtgcgatcacagatgcggatctgcaggcaaaagtggatgaactgctcagtgatattacggcgcagggaaaccgtcttgcggagcacatggacatccgggatatgaaaaagtaccgtggactgataaaagactttctgaatgaagtagtttaccgttcccaccggttttcaagggaaaattttcttgaccgcaggggacgccaccgggtatatggcattatccgcctgatcgataagaatctggatgaactggcaggcgaactggtggcagacgaaaaggatcatatttcgattctggaccgtattggggaaattaaaggacttttgcttgatattttgacctagacagatacaaggaggggatggctatggcaggattttcagacatcattggacatgaacagatcatcgggcatttgaagaatgcaattgccctcgacaaagtcagccatgcatatatttttaacggaccaaagctttccggaaaaatgatgcttgcagaggcttttgccatggcactgcaatgtgagggagaagggacaagaccatgccttttatgccgctcctgcaaacaggcggtggatcataatcagcccgatatcatctatgtatcccacgaaaagccgaataccatcggggtggacgatatccgtacccagatcaataacgatattgtgataaaaccatacagcagccgctacaaagtgtatattgtggatgaggcggaaaaaatgaaccagcaggcacagaatgcattgctgaaaacaatcgaggaaccgccggcatatgctgtcatcctgcttctgaccacaaatgcggacagttttctgccaacgattttatcgcgctgcattacactgaatctcaaagtggtaaaagaagatgtgatcaaatcttacctgatgaaaacgtatcacattccggattaccaggcagatgtctgtgccgcattttcccagggaaatgtagggaaagccattcagctggcatcttccgaagaatttggggaactgaaagcatcggtgctgcagctgatgaagcgtctggaagatattgatctgtatgaaatgacagcagcagtaaagcagattgcagagtataagctgacggtcaatgattattttgacctcatgatgatctggttccgcgatgtactttacatgaaagcaaccaatgacgtaaacggactcatttttaaggatgaggtttatgacataaaaaaacaggcagcaaagcggtcgtatcagggaattgagacgatcatccgtgcactcgagacagcgaaagtccggatttcggcaaatgtaaatttcgatcttgtgattgagctgctgttactgacaattaaggagaattaatatgataaaagtggtaggaatccgttttcagcgtgcgggaaagatttattattttgacccgctggattatgatctggagacggcgatgcacgtcatcgtggagacggcgcgcggcgtagagatgggaacagtgctgatcccacccaaagaggtggatgacgataaggttgtccagcctttgaaaccggtgatccgtattgcgacagacgatgacgaaaaagtcatagaaaaaaataaagaaaaagaagcggaagcctacgtgatctgcaaggaaaaaattgcaaagcacgggctggatatgaaactggttgcagcggaatatacatttgacaacaataagcttttgttctactttacggcagacggacgaattgatttccgtgagctggtcaaggatctggcttcggtgttccgcacccgtatcgaattgcggcagattggtgtgcgcgatgagacaaagatgcttggcggtatcggaatctgtgggagggaactgtgctgcagatcctatctgaccgattttgtaccggtatccatcaagatggcaaaggaacagaatctgtccttaaatccgacaaaaatttcgggtgtatgcggcagactcatgtgttgtctgaagaacgagcaggaaacatacgaatacttaaacagccgtctgccgtcggtgggagattcggtaatcacaccgaccggaatgcatggagaagtgtccggtgttaatgtactgcgtcagctggttaaggttgttgtggataacggagaagaaaaagaactgcaggaatatgcagtagatgatctgaagtttacaccgcggcgccgcagggatgtccgtgtaacggatgaggaaatgaaagagctggaagggcttgaggataacggaagcacggaggaagaaaacgaacgtccgcagcgggagaaccgcagggaaaacaaccgtggcaaataccgcagagagcggaatgatacacgggataaaaatgaagcgcctgccggagaatcgtcacaggaacgtatggcaccagagacagatgccggaagtgaaaaccgtgaaaaacgtgagtacaaagaccgtggcaattaccgtggaagaaactacagggatcgcggcgaaaagcgcgagtaccgcgagcagaatgaaaacggtgagaaacgagagtaccgggaacgcagcaattaccgtggcagaaactataatcgtgaccgcggagagaatgccgaccgtgaaaacagtggcgggggcggagaaaaacgcgaataccgcggagagcggaatttccggcggcatcgaaactacgacagaaagaattatcagggtggaaacaacgaacgtggagaacaaaaacggggtgacaatccacagtcatgaacgactggatgaacttcatagaaacggctactggatcattcaggatccgggacggttctgttttggcatggatgcagtgctgctgtccggctttgcgaaagtaaagcccggggaacgggcactggatctgggtaccggaaccgggatcataccaattctgcttgaggcaaagaccaaaggggaacattttaccgggctggaaattcagccggagagtgcagatatggcggcgcgaagcgtcgcctacaatcatctggaagagaaaattacgattgtgaccggagatatcagggaggcttctgcgcgtttcggagccggatcgtttgaagtaatcacaacgaatccgccgtatatgatcgggcagcatggaatccagaatgatgccaatgccaagacgattgcaaggcatgaggttctctgcgatctggatgatatcctgcgtgaaagcgcaaagatgttaaagcagggcggacgtttttacatggtacacaggcccttccgccttgcggaaattttcagtaagatggtggcatatcatatcgagccgaagcgcatgcggctggtttatccgtttgtggataaggagccgaatatggtgctgatagaggggctgcggggcggcaaatcccgtctgacggtggaaaaaccactcattgtatacaaagagccgggggtatatatgccggagatttatgatatttacggatattaaaaaccgtggtgcatgttaagatgcatcacggttttttgtgggtaggagaacgtaataaatttacctgattttatcattgagggtcctcctttaatatagttacttctttttgtataaaagtatctaattcctttttgtgttgtacatttatgttgtagatatatatggctgagaatatcaaaacgaaaacggtaatgatgatacagatcgtttttatattccatgtaaaacacacatttttcttttgcttatcaattgattgctccgaaaaataatcgtttaccagttcctgtggatctccaaactgtgaaacaagctgttcataatcgagagaatcctgttgcgctgcataagaaatgacagcgtctttcaaatcagaaataaatcttgcgtctgtggtatggtagtgtttaaactgcttctgcacagcctttatatatttatccgtaattttatccttggtcattgtctcccccttcttcctcctgtgtaaccgtatatttcaatacctgttggatcgcattggcagtcgcgtaataatcctccaaaagttgttgaagatgcgtgcggccactgtcttccaggtgataataaacattcacctgacggcgtccaacctgttttttgtagtctgaaatatatccggcatctattaatttgtagagggcgggatacaaagaaccaactggaatattcaggtatccatcggtctgttcccggatcagggtggatatttcataaccataatagtcctgctggctaagcagatgcaaaattaacaattcgacggaaccgcgccggaagttacttttgttgttcataggtttctccttatctaattagataaacgtattataaaacaaacaagataataaaacaatgtatagaaaaactaaaatatagttgacatagataattgaatatgctaacgtgaaaacataacaagcaatgatgatatcttggaggatgaatggaagaatatagtgtattagatattttttcttatgtaccaaagcaaaaaattgatttggaacagttggaaactatatttgttaatgaaattaacaatgtaaatgcagcaacgaatggttattacgtcgaaaaatataaacaaatccatgagttagagaaaaatataaaaatagcggttgaagatttacagaatgaaggaaagaagattgcatttattaagaaagggcgaaagataatagctgtggtaggatataaggtaacataagctatattgtataggaaacagatatgaaaaagttttttctgatttttataataatttttagcctgataggatttgttgggtgtactcaaaaagatgatacaaaatcgcaatttattaaagattttgatatagatattgaggaaaaagatattgaacttaaagaagagtttaatgattatggaggttttccatatgagggaatggctctttataagataactctggatgaggatgctgctgaagaatttgcgaagtgggagagtttgccgttttcgaaaaaggctggggattttttgacaagtgtgtctacttatattgaacttccaacaattgaagagggttattggaaacttgttgatcggaatccaggaacaaaaatgtatacgaatgtttccttttgtgtatatgatgcagaaaataaaattgcatatttaataacaatggatagttagagtatttgaagggataaataatgttaaagaaaatattaccggtaattattataacggtctgtttattatttgcgggttgcaaagctcctgcagatcaagaacagaaaaataatacagaaacagctgtcttatctacggaaacacaggaagaggagtggaaacaggttcattctacacaaaaggatctggaaaaacttccgcagaagatacagaaaattttttcagataatcaaacattctttgatgtggaaaaaggaaaagaatatgataagaattcttttataaaaacattgacaaaagaaggttatcggccccagtgggcagaatttctggtggcagactgggataatgatggagaatatgaattagctgtttatataaataacagtccggattataatgactgcagaatttttgatgcgtcaaataagaaagtgtatgcgcatgcttttacggcccgtgcaattgagggaatcagtgatatgggaattatcagaggttcaagcggtgcagctgatacagactatgacagattgtttctggatggaaaagaacaaaaattttatgattataaaggggaaaagttatatctatcggtagaatatgcatggagccatgattccattgtctcggggatatgaaatcagagccggggggatatatgccagatatttataatttgcaggtatgaaaaaccgtggtgcatatcaggatgcatcacggttttttgttggcaggagaacgtaataaagagatgaagaatttaactggtttttcattgggtatcatcctcctttaaaataatgatttctcggtgaataaaagcatttctctcttcttgggctaaatgattgagagtataaaagaaaatgccagtacaccccaagacaatcaaaattacaatggtacaggttattttgacatttcgtgaaaagcgcaggcttcttttttgcttatcaatagattgctccgaaaaataatcgtttaccagttcctgtggatctccaaactgtgagacaagctgttcataatcgagagaatcctgttgcgctgcataagaaatgacagcgtctttcaaatcagaaataaatcttgtgtctgcggcatggtagtgcttaaactgtttctgcacagcctttatatattcatccgtaattttatccttggtcattgtatcccccttttttctactgtgtaaccgtatatttcaatacctgttggatcgcattggcagtcgcgtaataatcctccaaaagttgttgcagatgcgtgcggccactgtcttccagatgataataaacattcacctgacggcgtcccacctgttttttgtagtctgaaatatatccggcatctattaatttgtagagggcgggatacaaagaaccaactggaatattcaggtatccatcggtctgttcccggatcagggtggatatttcataaccataatagtcctgctggctgagcagatgcaaaattaacaattcgacggaaccgcgccggaagttacttttgttgttcataggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaaattaacaattcgacggaaccgcgccggaagttacttttgttgttcataggcttttccttattttgagtgtattgtaaattaaataagataataagtcaatatatagaaaaactaaaatatagttgacatacacaatcgaatatgctaacgtgaaaatgtaacaagtaattaaatattcaaacacaggagaataataatgaaaaaagaaggttccactgcttctatgctgtggctggatatctgtaggggattttgcagtaagcggttttggggcattgttggggtagttacaattgtttttgtagtgtttcttacacttgacatcatatatccattacaaaaatattataatgggtatggaacgtttgactggaaattggactcaatttcgatggctccatttgctgttcgtatcggtattttatcaatggatctgtttgtcactttttttccatttattggagtaatagcatatgctggaacgataatagatgagcgaaaagacggatattgttatcagattatacaaaaaagagggtttcattcctattactggagtcattttgtcgcaagtggactgcttgggggacttcttgcggtagctattcttataagcttatatctgttgacagacattgggataggacaaaatccattatggaaagatgcaatacaagtgtatcttacacccgaatttggatcggaaaacgagacggtttattttggcatccatattcttacaaaatcagcaggacacgttgaacttgtattgttgggaatggtcagcttctttttgacgggatgtttgtttgggttgttaggagcgataattgcatttgtatcagatgcacgggttcttgtatatgcaatgccaatgatcattatggagaccgggtgtgggggactttatgcaatttccctgttgtttggaagagattctgttgccgcaaatgtgctggcatatttttataacataacaggagcatatatttcatttggaaacttattaagccggtgcattgtgatctttttgattattttaatgctatgtattggaaaagggatggaatctaaagtagttcggtattatctcggagaggagatcagacaggtatgagagaaaccataggggcggttgttcgcaaaccggtgtttcgaataaaattaattgctatttcgctacttttcgttgtttcgttgattgaacaggtatccaataactatattcagtcatccgggcaacaggtgggaagaatgacggttattttattgttgatgcatacattcagttatttttcattttatctttcagtcttttttgttggatatatattattgattccagatatcgttaaggatgcatttatagaaaggcagaccatgatgcggtgtcagtcccgtatgcgggcggcaaagtatgccataggaaaaattatagccttttcgattctttatgttatttggtttgtaatgcttaccatccttgttggagggatctggttccatgacttttcattggcatggcctaaatttatggatatccagcaaagacagcttgcagccaatggattatctacaattacatggattaatataccggttggagcaggcaaatatccaacactgcttgtggcaggattaatctgtttgcgaagtacgattgggtttatttttctgggattgctggctttactggtaacattaattactggtaaaacgcgcaatggaatggggattgttattcttttggcagcgattgcaggctatgtaaaactatatatgaatgatgtatttacttattggaattcagcacatccgattggaaataaacgcagttatattcgtatatcaaaggctaccataacaccattgtttacaacctgtctaaaatcggatcaatttatgccatggatgcgctatggtattattgcgggcattcttttatgtgtcatcaccggagcaggaattatgctttattacaggaaaggggatttgggcgatgaggatcgagatgaataatattaacaaaacaataaagggtgtatcgcttctgacagacattaacctggcactggaatccggtcatatctatggatttgtcggagataatggcagtggaaaaacggtattgttcaaggtattattgggactgatgcacaagacttccgggaccattctggtagatggcagggaacagaaggatctgatgcaggatgttggtttcatcattgagcgtccggagtacataccatattattcagcaaaaaagaatctggaaatcatcgcggcctatcggaaagtcgcagatgatcagcgcattcgcacggtattggagatgtttggcctggacccgtcggataagaaggcagtggggaagtattcgctcggtatgaagcaaaagcttgcactttccatggcatttctggaagatccgaaagtattgatactggatgaaccgctcagcgcgctggatgcagattcggtgcaggaggcccgcaagcgtattttggaggaaaaggagcgtggaaagctggttcttattgcatcccattatccggaggatatccaatcactgtgtgatgaggtatattggatgaagagtggacatattcagttacagtaaattttgtaattggctcgtaaaaatatctgcggtttataaaagtgaaattttatcccatttgctttttccggtaaaaatatttgcattaaaatgatattattcccgtaaccatctgcaaatatcaacaacttgcacaccttgataatcataggtttcatgatgcgtccttgcaattatcatcttaggatatgcatcccttattgcaagcagtggtgaatgttctctttcaaatattttttcatccgaaatattatcgcttacctgaatatatatttgcgtctcacgtttcttagctacaaagtccacttctcttttatagagtttcccaacatatacctcatatcctcttctgcgtaactccagataaacaatattctcataaactcttccaaaatccatgtttcgtgtaccattgactgcataacggaatgatgaatcgcaaagataatacttgctattgttcgctaggtattttttcccctttaaatcataccgttttgcctcatagaacagaaaagcattttccaaataaccaatatatttcgataccgtctttcgggttatctcacttcggtcattgtttaaggttttgctgatattatttggagaaagtaagttaccaatattatccatcataaattctgatatattggtaaactctgatttatttcttatcttatacttttctaccaagtctctgacaagaatggttgaatacacatctctaacatagtcatactgtctatcctcagtcttatatacataagcccccggcatgccaccagttcggacatactgatcaaatgcatcgtcatatccatctgtaatttcataataagttagatattccatgaaagaaaatggatatacctttatttccatcgttcttccggtaaaaagtgttgccaaatctgaactcagaaaaaatgcatttgaacaggtaatgtaaatatcatagattcctttggcgtaaatactattgattgcaagtatgtaacaaactcttgcagcaatacggatttgccgcttcgtctgatccccgtgataacttttatatctggtgttccatacaattcaatcagttcatctaaatacttttttcttactataagctgcatggtgccatcccctattcccacttttagaaatttttttatttttcggtaatataattttcaaacaaatattaacacaatctgtatcttctgtcattattctattcccactttttaaaaaattgaaaattgcaaagtttaattctaccatccatttatacagtggaattctcttctgcagaagagaattccactgtataaatggatggtagaattaaactttgcaattttcagggtttttgctgtcgataaataaaactttctattgcacatattatttggtataatatatggataaaagaatttttattatttctgcggggagaaaactatgaactatggaagaacttctttgcgccggagagcaaaacagctggacgcaagaggaacgagaatacgtcataaaatcggagtcatactggggaaacttctactgattggaatcattgtgggaggctgtgcgacagtgagttttggagtgggtgcatttaaaggaattcttgcatccgcaccggatatatccgaagtggatgtcattccaacgggatattccacgaaagtgcttgcggcagacggaagtgagacagcaaaattagtggcagccggatccaaccggcagtacgtgacaattgaccagattccggagaatctgcagcatgcggtagtggcgatcgaggatgagcgtttttatgatcataacggtattgacctgaaaggaattgtcagggcactggtggcggatgtccggaccagagatttcagtcagggagcaagtacgcttacgcagcagctgattaaaaataatgtgctgagtgagcagtgggcaaacgaaaatgacagtaatatttccaaaatggaaaagatggaacgtcaggtacagcggaaaatacaggaacagtatctggcaatagagctggaaaaaaaggtaaatgacaagaactggattctggaaaattatctgaattccatcaaccttggaagcaatacccttggggttcaggcagcagcacagcgttattttgggaaagatgtgtcaaagctgacactttcggaatgtgcggttattgccggaattacaaagaatccggcaggttacaatcccattcttcatccaaaggaaaatgcaaagcgcagaaagaatgtgctggatgccatgaaaaaacagggatatatttcgcagaaacagtatgataaagcgatggcagatgatgtgtatggcaggatttccgaacacaatgatgtgagggaagaaaccatgaacacatattttgtggacgcggtcattgatgatgtttttgatgatctggtaaatatcaaaggctattcggagtcagaagcatacaaggcaatttatcaggggggattgacgatcaagtccacacagaatcttcaaatccagaaaatctgcgatgaggaggtggcagacaaagccaattatgatgcgggtaccaaatattcattctatctttcttttcaggtgaaggagaaggatggtacaataaaaacatataccaatcagacaatgctttcctattataaaaagaaaaacaaaagtcagaattattcgatcaattttgcatcggaggaggactgccgggctgcaattgcacagtacgaaaaagatgtcctcgggaaaggggacaagctggtagaaaattcagagtatattttcattaccatgcagccacaggtggcgatgacgattatggatcagtcgaccggagaggtacaggctattgtcggcggacgtggaaataaggcgggaaaccgtacctggaaccgtgcaacaaagacctgccggcagccgggatctacttttaaaatcattgcatgctatgcgccggcacttgatgccgggggaaaaacgctggcatccgtgcaggatgatgcaccatttacagtcggaaataaaacatataataattactcacatacattcggaggttttacaagcatccggaaagcaattacaaaatccatcaatattgtgactgtaaaaacacttcaggatattggtgtggatctggggtatgaatatgcagaaaatttcggattttccacgcttaccgatacggacagaaaccttggaatttctctcggaggcctgacacagggggtgacaaacctggaacttactgcagcttatgctgcaattgcaaatcagggagaatataacgaaccaaatttttatacccaggtgctggatcatgacggcaatgttcttcttgataaaacacagacaaaggaacagcgtcaggtaataaaagaggataccgcatggcttctgacagatgccatgaaagatgttatgacgagtggaacgggtatgagggcttattttggaaccggaatggctcaggcaggaaaatccggtacgacaacgctgaacagggatgcactgtttgccggatttacgccttattacacctgcgtggtatggggcggatatgatgacaattccattcagtcagctacgggatatccaaagaatttgtggaaagccgtgatgaagcggattcatgcagatcttaaggcaaaagattttgaaaagccttccggaattacacaggctgttgtctgtgcaaaatccggacttctgccggaagcggatgtctgtgataaagacccacgtggaacgcaaagttatacggaatattttgcagaaggaacggttccgaccgagaactgtgatcatcatatttctctgcagatttgtgaggcatcgggaaaagttgccggagaatactgtccggcagatcaggttgtgacaaaaacttatattgtgggtgccgaaaagggctcggctgattaccagtactgtgcgacagagaaatttttaaatggaacatgcaatatacacgatgccgaaacgcaggatgaggagaagccggaagaagaaccggcagatccaccggatgatgcaaagccggaagaaacacatgaaccggaacagataccggagaagaatgaggaatgatacaaaggagaataggatatatgcgagtggtctataccggaggagagggtgaaatcacagagaagaaatctcattttatagcaacggtaaaacctgtccagtcagaagaagaagcggttgctttcattaatgagacaaagaaaaaatactgggatgcccgtcataactgttctgcttttgtcatcggggagaggcaggaactgacgcgctgttcggatgatggagagccggcacagaccgccggccgtccgatgctggatgtacttctccgggagaaaattacggacgctgcggttgttgttacacgttattttggaggtgtgctgcttggaacaggagggcttgtacgcgcctatcaggcagccacacaggctggacttgcagccagccggctcatagaaaaatgtaaggggcagcagctattggttcataccgattataatggacttggaaagctgcagtatctgttcggacagaaacacactgtgattctggatacggcatatgaggcggatgttaccatgacaattctcgtacctgcagaacaaaaagagatacttccgaaagagattacagaactgaccaacggatctgccggactggaatgggggaaaacctgcgtatatgcactaattgataaagaagttgtgtttttttgaaaaaatttgaaaatatgggttgacacttataggggttccatgtataataccatttgttgagagacatgaaacacattggcccatcgccaaatggtaaggcaacggactctgactccgtcatttccaggttcgaatcctggtgggccagctgaagagcactacattatgtagtgctttttgttttataaaagataagaataagaaaggacacggtaatgtacgaatttgacagcagagtaagatacagtgagacagatgtgcaaggccggatgacatggctggcgcttatggattactttcaggattgcagcgtatttcattcagaggccgtgaaccttggtgtggaagtatggaccgatgcacaaaaggcgtggatcttatcttcctggcagatctgtctgaaccggatgccgcggctgggcgaacagattacgacacagacatgggcatatggaatgaaaggcttttacggttaccggaatttctccatgaacggcagggatggggaacggatggcatatgcaaattccgtatgggtactgatggatacaaagaaggggattccggtcagagtgacaaaagaaatctcggatgcatacggattggacccacagcttcccatgcagtgcagcgagcggaaaattatgctgccggaaaaatatgaagaaaaagattcattggtcgttccttcttatttcatagataccaatcaccatatgaacaataccagatatgtacaggtggcgatggaatatgttccgaaggagtttcggacaatggaagtccgggtagaatataaaaaagctgcgatgtgcagagatgtaattgtgccgcatgtgacgatagaagatccccgtgtgacggttgcactgtgtgcgccggatgggcagccatatgcagttgttgtttttttgaaagcgtaggaaaaagatgaaattagcagaatatcaggatttgtattatgtaaaaaaagtagacttcggagtatatctggcagaggatatgggcggtgagacacatgtgctgcttccgtcaaaacaggtgccggaagatgcaaaaccgggggaaaagataagggtctttttatataaagattccaaagaccggctgattgcaacaaccaacacaccgaagctgacactgggagaatatgcaccgcttgtggtgaaagaagttggaaagatcggtgcttttctggattggggactggaaaaagatctgtttctgccatataaagagatgacttcacgggtagaagcaggagacgagattcttgtaaccctttatattgataaaagcaagcggctttgtgccagcatgaagggactgtacgatctgctttccaaggattcaccgtatcagaaagatcagatggtaaccggaagggtgtatgagttttccgataactttggtgcttttgtggcagtggatgatcgcttttccgcaagaataccaaattcagaggatcacagtttcctgaaaatcggagatgtgattgaggcgaaagttactgcagtaaaaccggatggaaagttagatcttacactgcgggaaaaagcttatattcagatggacacggatgcagagaaaatacttgaattgctggattcctatgcaggagtgcttccgttttcggaaaaagcgagtccagaggtgattaagagggaaaccggattgagtaaagccgcgtttaaacgtgccatcggacacttgtataaagaaagaaaaattacactggatggtggaaaaatccgcaagagtttcgtataatgcaggtaaaggcaaaaggaggaatataaaatgaaaaacgtaatcagtacagataaagcaccagccgcaatcggaccgtactcacaggcgattgaagtgaacggaacggtatacacatccggcattatcccggttgttcctgctaccggagaaattccggaaggatctgtggcacaggcgcagcaggcatttgaaaatctgtcaaatctgcttgaggcagccggaaccggaatggataaggtagtaaaaaccactgtttttatcaaggaaatgaatgattttgcagcaattaatgaagtttatgcaaaatttttcccgtcaccatttccatccagaagctgtgtggaagtggcacgtcttccgaaagatgttatgcttgaaattgaagccattgctgtaaaataaagaaaagatcaaaaacgaaaagagatctgtgcattgcacagatctcttttgttgtctttgcggttctttttccggttagacggaaacgtcaatgttacttcctaaattaggataaacagagttctccatcatttttgccagcccaacaccaagcgattcattcgatgagatggcattgtcaagcattttaatgctgacggcatttgccagagagccgggatcggaactgtttacggaaagaagcgcagaactgatacttgaaatatccatatgacagatctccttttaaaatactcggtatacgtgtttttctttattacatctttattatggcataaatatacgaaaaattcaattgaattctgtggatggaaaaggggttgacacatatccgtgcctttgctataatgacaatgtaataattgtaacaaattcgtaataaagaagtacaaaagtcattggaggcgaaaatgaaacgtaaaacattattaaaattgaccgcatgtgggttagttggggcactgaccattggcaattttactgtagcagcttacgcagcaccaactgctggagtcgcaagccttgcttccgatattgcaacaacatcatctgcaccgactgcaggattttcactggcactcagtgaagtcgcagaaaaagtggaagatgaggcaaccgttgcaagtgcacagccggaagtaaaagaagttgaagcaccagttgtaaagtctgagtatgaagacaaagcggtagctgttgtggaggattacgtgaacgttcgtaagaaaccaactacagacagcaaggctgtaggaaaattatataagaataacgtaggaaccgtcatcggggagaaggatggctggtacaaaatcaagtctggatcggtaacaggttatgtaaaatctgaattcgtatccgttggtgatgagaaaaaattaaagaaagcaggaagaagagttgctcttgtagagacagagacattaaaagtccgcaagggagcttcccagaaggcagaagtaattactctggtgccggaaggagacgatctgacagtactggatgagtcaaaggatggatgggcaagggtttctgtagatgaaggcaaaggctatgtatctacagattatgtcacattatctacagaatacacatatgcagagtctgctgcagaagaaaaggcaagattacagaaggaaaaagaggagcgtgaggctgcggacagagcagcacagaaagcagagagtgcatctcagacaacctcttcaggttcttcacagtcacaaagctcagattcttccgtacaggattcatcaagtgcatcttcaacaggatcagcggttgcaagttatgcaggacagtttgtaggaaatccatatgtatatggtgggacaagccttacaaacggaacggattgttccggatttgtaatgtctgtatacgcacatttcggtgtcagccttccacacagctcaagtgctttaagaagtgtaggatatggcgtcagcacatcaaacatgcagccgggtgatatcgtatgttacagcggacatgttgcaatctatgttggaaacaatacgattgtacatgcaagcaatgcaagagacggtattaaatatacttctcctgcaaattacagaaccattcttgcagttcgaagaattttctaacaattaagataacataagtataacaggagcacttgcgaaagcaagtgctctttttcttaatattatttaaggatttcttaaatttgcaaaaaacagattttgcaagggaaataacattgacaagcacaatcatataaagttactatgtaaaatgagtagtttattgaacggtaacagagggaggaacagaaattggcatttaccaaggcgaagatagttatggcaggactggcggtgacggcggtttgtattgtggcgccacagcagttaaaggctcaggtgcccgaagcgcagatggatggcgtcatgggacagagcatagaggatgagaccgtgtatgagtcaaagccggatctggatacactgatagaaaagaatgcacctgttttcgggaatgggacatccttgaaaaaagcatcgtcgtattcgagtgcttttttgaatgcgtcttttacgacggccggtgattataccagcgcaacctattatcacaaagcggactatgcggatgatgaactggtcaacggaattgatgtatcatactggcaggcggatgcagcactgaagaaaaagtattccaaagacaaaacaaagtggacacagaccggattggactgggaaagtattcacggagccggaattgattttgctttcgtgcgtgtggcatccagagatacgaaagatggaagtatttacagagataattgtgcagacagtcatattcagggagcagtttccaatgatatcaatgtcggactgtatttcttttcccaggctctgaatgagacagaggcacgggaggaagcacagtatgtgctcgatatgattgaccagtacggctggaatgtgtcgatgccgatcatcatggaccgggaggcaggggcaaacaagcgtctgactgcgggaaaactttccaaaacaaaagagacagcggtatgtcaggcatttgcggataccattacggcagccggataccgggcaggcgtatatgcatcttatgcgtggatcaaaaactatatcaatacggatgctttgtatgactgttccctgtgggtggcacggtacaacaataccacgacaagcaatacaaagtcagggacaccatatgcggatacggcatatgattacgaattctggcagtattcgtcaaaaggggaagtggatggttatacaggagtccttgatgtgaatttctggtataaggataccagtgaacagataaccggactgaaagcatcggatgggacttcgggaattgtgaatctcagctgggacagtgtttcggcagaagatgtggacggttatcaggtatggcgcagcgactcggatcagggaaaatatacgcttctaaagtcgacaaacgactgtagttatacggacacaacggcagaaggagggaaagtctatcagtataaagtgagatgttactggacgataggggggaatgcttattacggaacattttcctctccggtttcagtgattacctcgctggaaaaggttgctggaatcgcaacacagacgcggacagagacttcgcttgggttgtcctgggaagaaacacagggggctgtggggtatcagatttatcagtacagtgcagcaagtagtcagtatgaaatggcagctgacgtgggagatggaagcacttcttatacgataagcggcctgacgggggcgaacgaatataagtttaaaatccgtgcttatgaaaaaaataatgatcatgtacttctgggccagttttcggatgtttacagtgatgtgacactgccgggtcaggtggatctgacgaatgtttctgcaactgggacttcttccgtgaaactgacatggcagactgtggatgggatcaccggatatatgatttaccggctggatacagcagacggtaaatacaaacaggttgcgacagtaaaaagtgcccagacgcttttctacaccgatcagaagcttgcagcaggaaagacttataaatataaagtatgtgcatacaaaacgtataaggataaaaattataaaggtgcgtattccacagaaaagcaggtgaaaatcaaaaaaacagaaaagcctgcaaaagtaaaaacgataaagctcagtacaaaagatgcagcagttaccgtgcagtggagtaaggtttccggggcaactggttatcaggtataccggctgaatacaaagaccggaaagtatacaaagattgcagcggtcaaaggaacttcgtatcggaatacaaaactgaaaaaaggggcaacctatcgctataaggtccgcgcatacaaaacggtaaacaaaaagaactattacggagcattttcaaacaccacagcaattaaagtaaagtaggaaacaaatgaaaaagaaagtacaaatgaaaaaaatggcaggcgtgtttttgacattggcaatactgggaattggtcttttcccgccgggaaacgtgtatgcggctgcaaatcaggcgccggacgcagatccggtggttgtagttcttgatccgggacatggagggcatgatcagggtgccagatataagtgggacggaaaaacatacaaggagaaacagttaaatcttgccattgcaaaggtctgtaaaaccgaactggaaaagtatgcaggagtgaaggtatatatgacgcgttcttccgaccgttttgtgacacttggaaaccgtgtgaattttgcaaaaagcaggaaagcagatctgtttgttgcaatacacaacaatgcttccctgaaaaaaaccgaccatggagcctgtgtttattatccgaacagcgggtataaagaagaggtgggaagtgaaggaaaaatggcggcagcaagtattcagaaacagctggtggcacttggactgaaaaataatggaattctttaccggaattcggctgtggggtcccgctatccggataaatcaaaggcagattactacgccgtgatcaagcggagcaagtatgccggctttccgggactgattgtggagcatgcttatgtcagcaacaacgatgacagtacaacatttctgaatggtaacgaccggctgaaacgtcttggcgtggcggatgccacgggcattgcagaatattttgacctgattttagatcaggcaccggttctgcagacaccggttgtaaatgcggatgagtcggtgacactggcatggaatacggtgcagggggctgattattatcgtatttaccgcagaatcgcggggacgaaaacatatgtctgtctcgaagaaacagaggaaaccggatacacggataccggggtaatgccgggaacttcttatgagtatacggtatgcggatgccatgtgggatatcagaaagattcctacacaaaaattgcgcaggcaatgcagataaccgttacaggggaaaacgcgaatatacaaagtgcacaaaaaaatcaaaactaagatgggggatggaaaccacagatgtggataaaatgaaaaaattatccactatccggaatcaaaaaatgccgaaaaatcgagttatacacgaagttatgaacattatccacataatttgggataagttgtttgtggatgacagggataaaaacaaacgattgttttgttaacaacgcataaaaagtatgtatttgaatgattgcaaacgggaggtatttttgatatactagggaagttatgtttaaaacgattgattttgctggaattgaattggacaattataccgttcgggaaatgatcatgaatgtagaaaaggatatgtctgatcatggattccatacaatagaagaagtaaacatggatacgcttatgctggcagaaacggatgaacttgtccgcaaagccatagggtttgcggaacataccgtgattgcggaaaacggaattttagaagctgttggtgcaggatcttaccagcaccgtcatgagatcgaacatcatgatttcttttttgaactgatgaagcgggtggaacgcaatcatcagacggtgtttgtgatcggagataccgcggaacatgtggaaaagacctgtgtttttttgtcagagcattttggaaaatgcgagatcctgggagcagaagcgtttgaaaactgtcagggggggacggatgccatggtcaatgagatcaatgcactgactcctgatatgatcttaagtgttctgccaagtccggatcaggaacatttcctgatggagaattgtgagaaactgtctgccggactgtggtatggaatcggttcctgggattttacaaagcgcaggcagggactgctcggaaatatacggaatctgatccgcacgcataaactggagcggcagctgattcattatcatggaaagcaggaaagcatatcatgagggcaaatgtctggaaagaactggaaaattatttcctgattttgctgggcactgcacttatggccattgccattcagtggatttttgacagggtggggctgatcaccggagggtttactggtcttaccattatcatacgaaatcttacggaagcgcttctgccgggaggaattcctctgtggctgacgaatattgtgctgaatattccgatatttctgtattcctatatccggtttggaaaaaaatatatcgggaaaacgggctttgcaaccattttgctttcggtgtggctttatctgataccggtgatagatatgtcaggggatgattatatgcttgcagccctgtttggcggggcatttaccggcattggcatggcactggttcttaaggcgggagcaacgaccggcggaaccgatatggttgcggcgatcatccagtcacacatgcggcactatacggtggttcaggtgatgcaggtactggatgcagccattgtgattctcggattatatgtatttggtttaagacctacactttatgcagttgtttctatttttgtgtcgacaaaaatatccgatgcctttctggagggctttaagacttccaaagcagcttttattatcacaaaccggtatgaggaagtggcagaacggctgatggatgagcttgaccgcggggttacgggactgcacgcacaggggatgtacacagaggagaaaaagtgcgttctgtattgcgttgtatcaaggaaagagatcgtgcgtgtgaaagagattgtaaatgatgtggattcctctgcgtttgtaatcgtatcggatgtccgggaggttttgggcgagggatttctggaatattcggatgatttttagaacgatattgttaaaattttatagtgaaatattactaaccggaaaaagtggtaagagaggaaatgcataaaaaatatacatttcctctttctttttttggaagaatgtattaaaataaaagtaattgttcagaaaacaggtgggggaacgatagatttctggatgaaatatggggataaggagagctgactatgatatccaatcaaatacttcaaaatacaattgacggactgaaagcaattacacgtacagatttatgtgtgattgatgtagagggaaaaattctggtcgcgacatttccggatgcagaacagtttgtaactccggcacagaccttcgtggaatcgccggcggacagtcaggtggtaaatggctgccagttctttaaagtgttcgatgatcatcaactggagtatattctgctggcatatggagacagcgaggatgtgtatatgattggaaagattgctgctttccagattcagaatcttttggttgcctataaggaacgttttgataaagataattttatcaagaacctgattttggacaatctgcttttggtagatatatacaatcgtgccaagaaacttcatattgaaacagaagtacgccgtgtggtattcttggtggagacaaaccgtgagaaagatggaaatgagctggagaagatccggggactttttggtggaaaatcaaaggatttcgtcacagcggtagatgaaaaaaacattattgtagtcaaagaacttgcagaaaatgaaacctatgaggatttgaataagacagcagatgtaatcatcaggctgtttaaatctgataccaattgcaatattcatatcgcatatggtaccattgtgaacgaattgaaagaggtttcgagatcttataaagaggcgcgcatggcactggatgtcggaaagatcttctttgagggacaggatgtgattgcgtattcccagctgggaattggccgactgatttatcagcttccaattccattgtgcaaaatgtttatcaaagaaatctttggtggaaaatcaccagatgattttgatgaggaaattctgacgacgatcaacaaattctttgaaaacagtctgaatgtgtcagagacttcaagacagctgtacattcatcgtaatacgctggtgtaccggctggacaagctgcagaagagcacaggtctggatctgcgggtttttgaagatgcaatcacgtttaagatcgcactcatggtagtcaagtatatgaagtatatggaaacactggactattagagattgaaggagagattatgattacactggaacatgtcagcaagacatatgcggcaggagttcctgccttaaatgacgtgagtctggaaatagaagatggtgaatttgtatttgttgtaggagacagcggttcgggaaagtcaaccctgattaaactgttgttaaaagaactcgaaccaacggaaggaagcattaccattgcagggaaaaagcttgggaagatccgcagaaagcagattccgaaattccggagaaacattggagtggtatttcaggatttccgtctgttgaaagaccgcaatgtctatgacaatgtagcgtttgcacagaaggtggttggtgagccgaacagccatattaagaaaaaagtaccacttatgctttcaatggtagggcttgccgcaaaataccgttcttttccgaagcagctatccggaggtgagcagcagagagtggcaattgcccgtgctctgatcaatgagccgagcattttgcttgcagatgagccaacaggaaatctggataacaataatgcatgggagattatgaagctgctggaagaaatcaacagcaaaggaactacagtgattgttgtaacccataatctggaaattgtgaaagttatgaaaaaacgtgtgatcacagtgaaaaagggtacgattgtcagtgacagtaaggaaggtggctacgacgatgagaattaatacctttttttattcgatcagacagggcttaaaaaatatatttcgaaataaaatgttttcgcttgcttccgtggcaaccatggcggcctgcatttttatgttcggtctgttttatattattgtaacgaatttcagtgcgacggtacattctattgaagagggtgtgtcagttaccgtattttttgaaaatgatgcgacagatgcacagatccgtgacatcggagaaaagattaataagcgtgccgaggtcagcaaaaacgagtatgtgtctgccgacgaggcgtggaaagaatataaaaaagtatattttcagggaaaagaagaacttgcggatggatttacagataatccgcttgcgaattctgcacattatcaggtgtatctgaacgatgtttcgatgcaggattcccttgtaacctatatcaagggacttaccggggtgcgcgaggtaaaagagtctgccaaggtggcaaatacactgacggattttaataaactgctgggatatgtttccggaggaattattctgattctgctgtgtgtggctgtctttttgatcagcaataccgtaacggtcggtatctcggtccgtaaggaagaaattgccattatgaagctgatcggagcaacggattttcttgtgcgtgcgccgtttattgtggaaggaattgtgatcggactgatcggagcagcgattccgcttggtgtgctgtattttatgtatcagaagatcattgtctatattgcagcgaaattcaattttatcggttcgatgatcgtgtttgaaccggtgaaggttgttttccggacactgattccggtgggagttatccttggagccggtatcggatttatcggcagtcagatgacgatccgcaaacatttgaaagtataatattgttattgttgtcataaaatgacaagaagccatgctgcaaggtgtggcttcttgatttatagggaaaattatggaggcaggaatgcaggaagaacaggaagaaatgatcaaaaccgggaaaccggaaaaaagaagaccatcgggctttaaaaacggagtgattatcgggctggtgctgggactgctgattacgggaatcggtgccggagtcggaatccgtgcgtatgcgaatcttacaaacaattatgttatatttggaccacagggagtaaaacagacagccaaagacaatgttctcgaccaggcggcaataaagaaagtggatgagctgttgtcatatatcgatttgtattacaacgattcttacaaagaaaaagatatccgcaatgccatttataaaggaacgctgagcgggcttggagatccttattccgtatactacacggtagatgaatataaagatctgcagacatcaaccaatggaaattattatggaatcggtgcggcgctttcacagaatgtaaagaccatggaagtgacagtggttaaagtgtacgagggaacaccggcagaggaagcggggctgaaaaacggagatgaaattctatccgtggataagtatgaagcgaccagtatggaactttccaaccttgtaaaaaagatacggggaaaagaggggacaaaagtccatttgaaagtttatcgttcgcagaccggggaaaatcttgaacttgatgtggaacgtaaaaacgtggatattccgagtgtggattccaaaatgctttccgatgggatcggctacatacagatcagcgaattccagagtaataccgcaaaacagtttaaaaaggcacttgcagcacttgaaaaggaagatatgaaagggctgattgtcgatgtgcggagcaatccgggcggactggtgacttctgtcgtggatattctggatcagattcttccggagggaacggttgtttacacggaggataaatatgggaaaaaagagacatatacatccgatgcgtcctgcatgcattatccgatggcagtgttagttaatggagacagtgccagtgcatcagaaatctttgccggagcaatcaaggattatgattatggaacattgattggaacaaaaacgtttggcaagggaattgtccagacggtatttcctctggaaaacggggatgccattaaaattacaaccgcgaaatattatacgccaaagggacattacattcacgggaaaggcattcagccggatatcaaactggaatacaaatacagcggtccggaagatgaaagttatgacatgaagtacgataatcagttacagaaagcaatttctgttgtgaaagaaaaaataaattaaagggtaacaatgaaaagaaaacgtgtatggagaattgtcagtgttgcgttgattgttgtatgggctgtggttattttttcgttttccgcacagccggatacggagtcttcggaaatcagcgggcatgtgagttaccggattgttaagatgtggaatcaggtgtttggattaaaacattccgggccggaactggaacagatggcacagaaaattgaatatcctgtgcgcaaagctgcacatatgagcgaatatgcagttcttgtacttctgatatttcaggcattgacggcatttgaccggaaaaagaaccgtggatgtatggcacttggcataacggcagcctatgcagcaaccgatgaatttcatcagctgtttgtgccgggaagagccggaagagtgacggatgtgctgattgattcggcaggagcatttcttgcattgcttgctattcatattattttatattatcataagtctgaaataagaaatagaaagaggtgattctgtggtagaattggataattttaagagccagctgcaaagctacaaggctccactgcaggaagtgagggattcactttgacttagctggcaaagaacagcggattcaggaattggaacgggagatggaggcaccggatttctggaacgatccggaagtttcccagaacaagatgaaggaagtcaaaagtttaaaggacgatgtggcaacttatgcggcattgtcggcgcaatatgatgatattgaaaccatgatcgagatgggatatgaggaaaatgatccggaactgatcccggagatcgatcagatgatgaaagaatttgttcagacctatgaggatatccgtatgaaaacgcttctgtcgggagaatatgacaggaacaacgccattgtttccctgcatgcgggagcgggtggcacggaatcctgtgactgggcagccatgctctatcgtatgtatacccgatgggcagataaaaagggattttccgtggaagtgctggattctctggatggagaagaggccggaatcaaatccattacatttcaggtgaatggggagaatgcatatggatatctgaaatcggaaaaaggtgtgcaccggctggttcgtatttctccgtttaacgcggcaggaaaaagacagacttcttttgtatcctgcgatgtgatgccggatatagaagaagatgtcgatgtggagatccgggaagaagatatccgtattgatacgttccgctccagtggtgccggaggacagcatatcaacaagacgtcttctgctatccgtatcacgcattttccgaccggaattgtggtgcagtgccagaatgagcgttcgcagcatatgaacaaggataaagcgatgcagatgctcaaagcgaaactgtatcttctcaaacaggaagaaaatgcagccaaagcagctggaatccggggcgaagtgacagatatcggctggggaaaccagatccgttcttatgttatgcagccgtataccatggttaaagatcacagaaccggtgtggaaagcggaaatgtggacgcagtgatggacggaaacattgatccgtttatcaatggatatctgaaatggcagagcctgggatgtccgaaaaatatggacagtgatgacgtgtaaataaaaacaggaataaggaggagcgtaatgggaattattaaggcagtaacgcaggcagttggaggtgcatttgcagatcagtggctggaagtcattgaagcagataatatgggggatcagaccgtttttaccaaaggaacactgatccgccgtggggaaaataaaaagggaacggacaatgtcgtgtcgaatggttccatgattcatgtatatgacaatcagtttatgatgctggtggacggaggcaagattgtagattacacagcagagccgggatattacaaagtggatcattcttccatgccgtcactgctcaacggacaactgggagactccatcaaggaatcgtttgaccgtttccgtttcggcggacagacgccgcagaaacagcaggtattttttgtcaatctgcaggaaatcaaaggcattaagttcggaacaagacagccaatcaattattttgattcgttctataatgccgaactgtttttgcgtgcacatggcacatattcgattaaaattgtagatccgctcaaattttatgcggaagcggttccgaaaaataaggatcatgtagagattgacgaaatcaatgagcagtatctgtctgagtttttagaggctttgcagtcatccgtaaatcagatgtcggcagatggtttccgtatttcttttgtttcgagcaaggcaagagaacttggaaagtatatgtcatcggttttggatgaggaatggaatcagacccgtggtatggaaatccaggcggtaggtatgacggtttcttacagcgaggaatcgcagaaactgctgaatatgagaaatgaaggagccatgctttccgatccgacggtccgggaaggatacgtgcagggagcggtagccagagggcttgaggcagcgggaagtaattccaatggttccatggccggttttatgggaatgggaatggcttccaatatatccggtggtatgatgggagcggcatcaaatgtgaatctgcagcagatgcagatgatgaatggaggtgcaccagctggaatgacgcagggggctgtacagggagcggtacctcctgctgggcaggaggcaccgcaagcaccgcaggcaccggcaggctggacctgtgcatgtggacagcagaatcagggaaaattctgttccaattgtggaaaaccggcaccgaaaaccgagtggacctgtagctgtggacaggttaacagcggaaatttctgctccaactgcggaaagccgagagcgtaaaaatcggggacagatccccgatacctcttgcaagattgatgttcttatggtagaatctttcaagtgagcacaagtgtcggtcgtagacagacaatacataagggaggaaatcaggatgggcgagaaggcatctttcttcgtattgcgggcaaaagccgtgcctgaggtattgctcagagttgtggaagcgaagcggctgctggattccggtaaagtggagtctgtgcaggaagccacagagatggtacagatcagcagaagctctttctacaaatataaggacgatatatttccatatcatgaaaatgcaaaaggaaaaacggtcaatatggtgatccagctggatgatgaaccggggctgttatccatggtattaaaaacaattgcggaatttcatgcaaacattctgacgattcatcaaagcgttccggttaatggaattgcttcattgtcgctcagtattgatgtgttccctgcgacgggcaatgtggaggatatgagaaacagtattgaatctgtgcaggggattcattatgcaaaaatattagccagggagtaagaaaaatgaagattgcagttatgggctacggcaccattggttccggtgttgtagatgtattaagaattaacaaggaaaagatcacaaagcgtgcgggagaaccggttgatgtcaaatatattcttgatctgcgggaatttccgggagaccctatggaagatgccattgtacatgattatcagacgatcgtaaacgatccggagatcggcatcgtagtagagaccatgggaggcgtggagccggcatatacgtttgtaaaggcaatgcttgaggctggaaagcaggttgccacttccaataaaaacttggttgcagccaagggagcggaactgattaaaattgcacgggatcacaacgtgaactttcagtttgaggcaagtgtaggcggcggaattccgattatacgtccattgaataaatgtctgactgccgatgagatcgaagagattacaggtatcttaaacggaaccacaaactacatgctgacaaaaatggcagaggaaggtgcagatttcgatgaggtactgaaagacgcacaggaaaagggatatgcagagaaggatcctactgcggatatcgaaggacatgatccgtgccgcaagattgctattttaacttctctggtgtgtggccagcaggtagattttgaggatattcactgtgagggaattacaaagatcacagcagatgattttaagtatgcaaaggttttgaaccgttccatcaagcttcttgcatccagccgtaaagtcggaaacagttacagttgtatggttgctcctttcatgctcagcgcagagcatcctctttgcggagtaaacggtgtgttcaatggaatcttcgtacatggaaatgtactgggcgatgcaatgttctacggcagcggagcaggtaagcttccgacagcaagtgcagtagtagcagatatcgtggatatgacaaagcacaaaaataccaatatttacattgactggtcaccggaaaaactgacactggtagattacaaagacagtgtaaacagtttctttgtacgcacttcttccggtaaggaaacaatcgaaaatgcatttggcagtgtagaatatgcagatgccggaattgcaggagagattggatttactacaaaagatatgacagaggctgaatttgaaaaagcggcagcacagattgaagttcgaaaccgtatccgtcttggataattttctggattgtatatttccaccacgctgttttgtatgcgaccgtctgctggaaacggcagatatccgcagacagcgaaatgttcacgcagcgtgccggaaaaaattgtatcccgttgtgcagccgtactgttatcattgcggaagcccgcttgcggataccgaaacagaatattgtcagaattgcagaaagcatcgttcttttgtggcagaaggacgatcgctttttgtatatcgtggggctgtgcagaaatccatgtaccggtttaagtatgcaaaccggaggagatatgcccgttttctggcggaggaagccatgcagcgctgggaaaactggatgcgggaaaaaaggatcgaagcaatcgttccggtaccgatgtattcgaaaaaagaacggtatcgcggatataatcaggctgcgctttttggcagggcactgtcagaaaaaatggatattccgtgtattccgcgtctgatgatccgggtgaaagatacacggccacagaaagaactgaatggcagagaaagagaaaataatgtcaaaaatgcttttcagagttcggataatgtagtaaaatataagagaattctgattgtggatgatatttatacaaccggatctacagtagaagctgtagcggagagattaaaagaagcgggtgcggaacaggtttatgtgctgactgcctgcattggcagaggcttttaggagggatactatggaagtaagaaattgtaaaatgtgtggcagattgtttaatgttttgaacaatgagcgtatctgtccggcatgtcagaagaaattggaagataaatttcatgaagtcaaacagtatctcgaggatcatccgggtgcttcggtagaacagacagcaacggataatgatatatcaaccaaacagatccggcagtgggtaaaggaagaaagattgattctttcctcggctacggaagcagggattgtatgtgaaaaatgtggcaaaccgatccgcacgggacgcttttgtgataaatgcaaggaaagaatggcaaacgaatttcagaatgcctatcagaaaccggaacctaagatggaagacttacgctctaccagagacagggaccgtatgagatatttaaaaaatgaatagtggacaaataaccagaccccggatatttccggggcttttttcatggaaacgggcgattggaaaacagactttgaaaaaagaactatctatggtataatagcaaataatgcatcattgtgtccaaattccgggatgcgttcgagacaggagttatctatgatcagtgaagaacgggtaaaagaattatatcatcttgcagcatttgatgaatatgaaaataaaaaatatcatcaggcgggagaatatacgatgtgggactatgtaggaaaagaaattgtaaaaagtttcttttcgggaaccatcgcatttattcttctgatcgtgttctggggactcggggatattgatacaattacgaaatggatcaatcgcgtggatcttacgacgttcgtcccgaaacttattgttgcatatgccggatttatgatcgtgtatcttctgattaccgcactgatctattgtgcccggtatgcaaaaggctatcgcaagatgaaagcatatggaaatcatctgaagagagcgcgcagattactgcgggaagaaaaataaaggatggggcataacagggaggatttatgacgaagttgttggaaataaaggatcagctgatccggttttacagtaaatatgaaacatatctgtatccgatcgtaaaatttgccgttgcactggctctttttaccgtgatcaataccaatatcggattcatggagaaaatcagccggtttccggtggcgttactgctggcgcttgtctgtgccattctgccgactggtgccatattatggattggcgcaattgtggtgcttgcggatatgtatgcgctttccatggaagtagcacttaccgcactgattttgtttgcgattctgttctttgtatattttcgtttcgcaccgaaagacggactgacggttgtgcttacaccgctgtgctttaaactgcatattccgtatgtgatgccggttggcagcagcctgctgcgcagtgcatattccgtgatcggagtggtatgcggtacggttgtctattatttcctggacggaattcaccggaatgcaggagcactgatgagtgcggcaaatgcagatgaggaacagtcttcttccaaatttgatatttcggtggggcagtttctgggaaataaagaaatgtatctggtaatcgttatctttgtgattactgccattgtagtttatctggtacgccggatggaagtggataatgcctggacactggcaattatttccggtgcgcttattcagattgccggattatttgtaggttatattgttcttggagttacaggaaagacattatggctgatagccggcaatattatttccctgcttattgcatttatccttcagtttctgtttatgaatctggattatgcgcggaccgaacgggtgcagtttgaggatgatgattactattattatgtcaaggctgtgccgaagaaaacggtcgctgtccgtgaggttacggtaaaacatttcggaaataccgcaagcatgggaaagcggattgaccatagcagatccgtgatgtctccggaagaggaagagaacagccggaaggttattgcgaaagaactggacattgatgaggatttactcaaataaggggaacgaagcatcaaaataatgaaatgaagaaaagaggagccagatgcaaaattttctgggaacattaagccaattttatgacaatgcaacaggattgttcggtatgccggatatctctttttcctttgtggatatcgtggaaatactgatcatttccttcctgttttatcatattctgctttggattaaaaatacgcgtgcgtggaatctgttcaaaggaatcatcgtgattctgctgtttgtactcgttgcagcaatctttcagatgaataccatcctctggctggcagaaaatacgttgagtgtcggactgacggccctggtgattattttccagccggaacttcggaaggcacttgagaatcttggcggaaaaaatgttttgggaaagttatttgactttggaaaagtagaggaaaataaattttccgaccacacaattgacgaactgatcaaggcttgttatgccatggggaaagtaaaaaccggtgccctgatcgtaatagaagatgaaatcctgttaaatgaatatgtgagaacaggaattgatattgatgcaattatcagcagccagctgttaattaatatatttgaaaaaaatactccgcttcatgacggagctgttattgtacgtggagaccgtgtggtttccgcgacctgttatctgccattgtcggacagtatgacactgagcaaagatctgggaaccagacaccgtgcagctgtaggaatcagtgaagtgagcgattcactgacgatcgtagtttcggaggaaaccggtaaggtatcaatcgctatgcggggacagatttaccggaatgtcaatgcggattttctgagaggcaaattaaagtatctgcagaacagaaatcaacaggtgaccaaactgagactgctgaaaaggaggtttatgaatggcaaaaaagattctaaaaaccttggtgaataatctgggctttaaaattctggctgtagttcttgcatttatcttatggctggttgtatataatattgatgatccgaaaaaatcaaaaacatttacaacaaatgtaacggtagaaaatgcgtccgcagttacagatatgaacaagtgctatgaagtgctggacggaaccaacacggttacctttactgtgaccggaaaacgcagtgaacttgaaaaacttgatgacaccgatttctctgcggtggcagatatgaaccgtctgatcataaatgacaaggggaataaggcaagtgttccgatcgagatcagtgccaagcggacgtatacatccgtgagcattaacaataaaaacaaatatatggaactttctctggaagatctcatgagcagaagatttatgatttctgcggacaccagcggaaaagtggcagcgggatatgccctcggagaagtttccgtgacaaacccgaatgttttgaacgtgtcgggaccggcatctattgtgaaaaaagtagataaggttgtggctacgattgatgtggatggaatgtcatcgaatctgacggataatgtgattccggttctctatgattcggatggaaatgaagtggataccacccagctgaagctgagcaatacgacggtgacgatttcggcaaaaatcctgagtgtaaaggaagtaccgcttgtattttcgacaacaggaaccccatacggggaatatcgtgtagtggagatcagcagcacaccggatactgtgaaactgaaaggggcatccaatgtactcaatccgcttgtttcacttgaaattccggcaaacgtaatcaatgtgagcggggcaagggaagatgtaaagacaacgattgatatttccgaatatctgccggacggcgtggaactggtagattcttctgcggcatccgttacggtaaccgtcagaattgaagcgtatgcgtccagaacctatcatctgcagacatctgatatcagggtgaacagtctgccggacggcctgaacttatcttttgataaggcacaggtttctgtgacgatcagtgggctgcaggatgatctgaataagctgaatgcatcggagctggcagcatccattgatgcctcccagctgagcgagggaatgcatcaggtggaactttcactgaaactggatgaagatcattatgcatatcagccgattactgtcagcgttaccgtgaaagcgaagaatacacaggacggagatacttcgacagacagcggtgaggataccggcgaatagtaaagtatataaaggagttataattattatggcaagaatgtttggaaccgatggagtcagaggagttgcggggacagagcttacaattgaacttgcaatgaagctcggtcaggcgggcgcttatgttttaacaaaggaacagtcccaccagccgacaatcatcattggatgtgatacaagaatttccggaggaatgcttgcaaatgcattgatggcaggaatttgttcagttggagcaaatgctatttttgtgggagttgccccgacacctgcaattgcatatcttacaaggaaacataaagtagatgcaggggttgtgatttctgcttcccataatccgatggaatttaacggaatcaaattttttaatggagatggatataaattatccgatcagctggaggacgaaatcgaggcattgatccggaatgatatggaagacgttgtttttccgatcggaccgggaatcggcagggttgagtatcggtttgatattgtggatgagtatattgcgtttgagaaaaagacggttccggtagatctgtctgcgttgaagatcgttgtggactgtgcagaaggcgcaagttcctatacttcggttaagacgctgaaagatctgggggcagatctgatcgcgattcacacgaatccggatggaacgaacattaattccaattgcggttctacccatatggacgaactgtgtgcaagagttgtttccgaaaaggcagatatcggtattgcatttgacggagatgcggatcgtatgcttgctgtagatgaaaacggaaagctggtagatggagatcagatcatggcgatttgcggaaatttcctgaaagaaaacggaaaacttgcaaaggacaccattgttgtcaccgtgatgacgaatctgggattcagtctgatgggtgaaaaacagggcattcatgtggagaaaacaaaagtcggagaccgttatgttcttgaaaatatgttggaaaacggatataatctcggaggagagcagtccggtcatgtgatttttctggatgacaacacaaccggagacggacttctttccgcattacacttattgcaggtgatggtggaaaccaaaaagaaattatcagaacttgcacagatcatggaggtgctgccacaggcattggtcaatgcaaaagtgccgaaccataaaaaagaaagttacatggaatattcagaaattgcagaggcaatcggtgaactggagaaaaaatttgccggagaaggaagggttctaatccgtccatctggtacagaaccattggttcgtgtcatgatcgaaggcaaaaatcaggaagtgattcagcaggaagcaaagcagttagctgatctgattaccaaagttatgttataaggaggcgttcttatggtatcccaaaaagtaaaaattattaatcctacaggactgcacttacgtccggcaggaaatttatgcaaagaggcaatgaaatataatagcaagattacattcgagtacagcggaaatacagcaaatgccaaaagtgtgctcagcgtcctgggtgcatgtatcaaatccggagatgagattacacttatctgtgacggagaagatgaacagggagcacttcgggaactggtcgcttatgtggaaagcggactgggcgaataaaatttttgcggggtacaaccggaaaactacatgttagaggaaagttttaatgaaagataaatacaagcatttattgaattttacggcgaatatcatatcgcttgcggtggaagcgtgtatgttcggatgggtatggtatatgctctatattccgatgctggataaagcgaatacttttttcaacagaggtaactgggcagtgattggtatgtatgtactctttgtgttctttttcacgaagatatttggaggataccggatcggatatatgcggatttcggatattatattatcccagatattggcagtgattcttgcgatgattgttgcatattttgagatctgtctggtagccaacgattatctgccaccacagccattgcttctgatgacggtaacagagattatatttatcgttccgtgggtcgtactggtgcgaaaggcatatacgcgtctgtatccgccgcgccagatgctcgtgatatatggaaattattcgccggatgatttgattgcaaagatcaataccagaaaggacaagtataatatctgtgcagcggaaagttaccggataggttatgaaaagctgtatccgatgattcagaaatataatgcggtggttctgtgtgacctgccatcggaagtacgcaaccagattatgaaatactgttatcaggaatctatccgcacatatgttacaccaaagatttcggacattctgttccgtggggcggatgatatccacctgtttgacacgccgctgtacctgtcccggaatcagggtcttggcattgtggatctgtttgtaaaacgactgatggatattgtgatttccctgatcggtattgtaattgcttctccatttatgattgtgattgcactttgcattaaattatatgatcacggtccggtattgtacaagcaggagcggctgacaaaagacggagagccgtttatgatctacaagttccgcagcatgaccacacattccgaggatgcgggagcacgtcttgccgcaaaagaagatgcacgaattacgccggtcggtcgtgtgatccgggccattcattttgacgagctgccacagctgtttaatattttaaagggtgagatgtctgttgtgggaccccgcccggagcgtcagattattgcggatcagtatacggaagaaattccggaattcgtactccggctgaaagtaaaagcgggactgaccgggtatgcacaggtatatggaaagtataatacaaccccatatgataaactgaaactggatctgacgtatattgaaaattattctgtctggatggacattaagattttattcctgacattcaagattctgttccagaaagaaaacaccgaaggtgtggatcagaatcagacaactgcaatcaaataaaatgtcaaaggagacggtgatgagcgacattaaaatcagcatcattatgccggtgtataaagtagaagaatatgtgggtaaggcaatcgaaagcattcttgcgcagacctttaccgagtttgaatttttgatcgttgatgatgggactcccgacagaagcggagaaatctgtgaccagtatgcaaaaaaggaccaaagaatccaggtgattcacaaggaaaacggaggtgcaccaagcgcgagaaacacagccattgatattgcacagggaaaatatgtttattttctggattcggatgactgggcagaaccacagatgcttgcggatatgtacgaacttgccgagaagcatcaggcacagcttgtggtctgtggattttatattgacacttactgtggacagaatcatttgtcagaaaaaatctgtgtggacgacagggtgtttaccgatgcaaaagattttcgggaagaggcataccggtattttgaccgaaacatgctgtatacaccgtggaataaattgtaccgcatggatgtgatccggcaatacggactgtattttccaaaaacactgtgggatgatttcccgtttaatctgagttatctggatcatgtggaatcggttgtagtttctacaaatgcctactatcatttcatacgtgcacgcgcagagtcggagaccgcagcgtatcgtgctgacatgtacgaaaagagagaggaagaacagggctggatggaagaactgtttcgcagctggggtgtgaccaatgcggcaacgcaggagatggttgccagaagatatattgagcgcatagtgggatgcattgcaaatgtaacaagttcgaaatgtaccctttccgggagagaacagcgggcagagatcagaaagatgctgcacaatccgagggtagacaaggcactggcactggcaaaaccacggtcgggatatatgaaggttatgctattgcctatccggtggaaaaatgttacacttgcttggatggaatcaagcgtcatcacttttgtgaaagaacataatggaaagttatttgccagaatgaaagcgggcagatagaggtaggttgtggctattttacaaacaaacgatatttttaaaacggaattatcggaaggacagcaccgcctgtcaccggaggagattcataaggtgcagcaggttgtctatggtattacgatagatattacggaattgtgcagtgaattaaatattccctatatgcttaccgggggaaccgctcttggagccgtccggcatgggggatttattccctgggatgatgacgtggatatggttgtcgagagaaaatatattgaacgtctgcttgatgcgattgaacagaggtatccggaccggtattttgtagaggcaccgcttcggacaccggggtatctgagttcttttattcagattcaccggaaaaacacagtgtgtcgggaatatttagagatcccggaagaacgatgtggaattaaaattgatatttttgtggtggaaaacacctatgacaatgcctttttgcgccgtttgcacggtatgcgggtagaggcaggattattgctgctttcctgttatcggatgtatttatggagaaatgaattttataagttgtcccggggcaataaaaaggcagccaccatgatacatctgaaaagttttatcgggcggctgattgcaccgaccgggaaattttggtatgctcatgtacagcggctgatgcaaatgtgcagcaatgaccagtcagaatacattgttgtaccatcagggagaaagcatttttttggcgaactgaaattgcgaagtgattttttatgtgcgcaaaagcggaaatttgaggatcgcgaatttctttttcccaaaaacattgactggtatttgtcctatatgtatggaaattatatggaaattccgccggaggataagcgggaatatcatgttgtttatcagctgaaaatatagacagattgaaacaagcaagaggaagaatgatttatgaagaagagaatagatacgttttggcgttatcggaatttattatttgaattagtaaaaaaaggaattaagttaaaatacagaagatcttacctgggaattatctggtcccttctggagccggttatgacaacaatcgtacttaccattgtgtttggaacactctatggtaataaagatcacacatttccactgtatattctatcgggacgtcttctttattcctattttgcacagggcacgaaagtgtcactgaaatcgatccgacaaaattcggccatgataaagaaagtgtatgtgccgaagtatctgtatccgttatcatccgtactttataattttattatatttttaatttcgctgattgtattagtgcttctcggcatttttacaggaaattatccgacgctgcactggcttttgattgtttttcctttactggtacttctgatcatgacgtttggtgtgggaatgattctggctacgattggcgtgttcttccgtgatatggagtatttgtgggaagttgcgctgatgattgttatgtatacctgcgcaatcttctactatccggagcgattattaaagagtgggtattcgtgggtgcttacggtgaatccggtatataatgtcattattaatgtaagaaatattattttccatgaggcgtttaactgggggtgcatgacatatgcatgtgtgtttgcgttagtctctgtagtggttggagtgatcgtatttcataaaaatcaggataaatttattttatatatttagtaacaatatgcttgagtataaggagtattaaaacaatggcagagacagtgttgcgtgtggaacatgttggcatgcggtttaatctgagtaaagaaagagtggacagcctgaaagattatattttaaaatctattaccagacagatgaaatttgatgaattctgggcattaaaagatattaattttacgttggaaaaaggagaacgtattggtattcttggaacaaacggagcaggaaagagtactcttttgaaggtaattgccggggtatttaagccaacggagggaagcgtagtccacaaaggaaagattgttccacttttggaactgggagccggatttgacaaagaatataccggccgtgaaaatatttatctttatggagctgttcttggatattccaaagaatttatagacagtaaatttgacgagattgtaaaattttcaggcttgaagaaattcctggatgttcccctgaaaaattattcctcgggaatgaaaagccggctgggcttttccattgcgaccattgtggagccggaaattctgattctggatgaggttttgtctgtaggagatgccaaattccggaaaaagagtgagaagaagattctttccatgatggacaaaggtgtgacggtactttttgtatcgcacagtcttgagcaggtaaaaagaatctgcacgaaagcaatgattctggaaaatggttcgattcgaagtattggagatattgatactgtttcggcagaatacgaagaaatgatcagtggggattagaaaggataaaattatgatttatggagcaatgttagcaggcggtgtaggcagcagaatgaaaagtgcggtgattccgaagcagtttcttgaagtggaaggaaagccgatcatcatttacacccttcagaatatgctgaaggtagaccgctttgattatatttatatcgccacacacaaggattatctggcgtatatgaaagaaatggttcaaaaatatacagataagccggaaaaagtccggattatcgagggcggaaaggaacgcatggacagtatccataatgtgactgatgccattttaaaggacgaaggggtacatgaggatgatgtgattgtgatccatgatgcggtacgtccccttgtgacagaaaaaattttaaatgacagtattgatgcggcaggaacttatggcgcgtgtgtatgtgggttaccggcagtagatactatgctttattcggaagatggcaaagtagtgacaacgattccggagcgctctaaactgtttaacggacaggctccggacagtttctctttacctcggtttttggagatgcaggcaaatctgacagaggaacagcgggaagtgattacaggaacttcccagatctgcaccatgaataaccagccgatttatattatagagggagatcctctgaattttaagttgacaaccgatggggatctgttgatttttaaatcgatcattgatgatcagacggtataggttgaaaggagatagtaatgaaatcattaatagaaattccaaagacaatgaaggcactggttctgcatgagatcggaaagcttacacttgatgaggttccggtagagccgcttcgtccgggtacggttctggtaaagattaaagcatgcgggatctgttcttcggatgtggagcgcgtgtttatcaacggaacttatcatttcccgacaattccgggacatgagttttccggacagatcgttgccgttggagatgacgtggatgagagtctgctgggaagaagaacctgtgtattcccgatgctcccatgttttgagtgtccttcctgcaaaaagcagcagtatgcccagtgcagccattatgattattttggttcacgcagggatggcggatatgcagaatatctggttgttccgacctggaatctggtgttgtttgacgatgatctgtcttatgatgtggcagcaatgtgcgaaccggctgcggtaggaattcatgcgaacggacttgcaaatgtgcagaaaggacagtcggttcttgtaatcggaaccggaatgatcggttatgtctgcgctgcatttgccagtcagatcacagataaagttattatgtgtggaaattctgctgcaaagcttgagctggcaaagaaatacggatgggaaaccattgcactggaaacagacaattttgaagaacgtatcaacgcactgaccgatggggaaggtgtggatgtagttatggaagttgtcggttccaatcaggcaatctgcaatgctgtggcggcagcaggaccgaattcaacgatcgttctggttggaaatccaaaagcggatctgaccatggaaaagaatttatactggaaaattttaagaaaatccattactttacgtgggtcctggaattccagctataatgacaaacagaatgactggaagacagcacttgaccggctcaaaggcggagaatttgatcaactgatcacacatcgcttcccgatggaagaatcggaagacgctttccgtgtgatgagagacagaaatacattctctaccaaagttatgtttgttatggaataaatacagaagttagaaatggagatacacaatggaactcgcgatatccaaattgactgcccgcagggttatatattattttgaaggttatgtaaagggagagagaccgaaaggtttaaaatttgttttttataattatgatttgaagattaccataaaaccatccgtatttgagtgggatggggataccttccgtatgatgcttcatgtggagcaggcaaatgagaataatccgatttccagtggtgattattatccgattgctgtggatggaaaaggaaagcagtatccattgcaggtggcaaaaagcattattgaagaacgggaacaggcggagtggaaaaatgatgtggtcgttaacaaaggaaaaggacatcatgtaatctgtaaatccttaatggatctggatacggatgaactttttattcatgttgataccgtgctcccgaaaccgcgtaaaaattatattcgcagaaaatgtggggaattatattatggagtgcgtaacgatttaaaggattgggcccagaagctttttgtggttgtttttaatattttcaacaagtgctgtaaaaagcgtggcaataagattttattctgttccggatcacgtgctgaaattggtggaaatgaagaatttatttacaaccgtatgcttgagcgtggactggacaaaaaatataagtttgtactggatttcaaacctacgatcaataagacatacggaccgtttaaaatgattcggtttatctatcgtctggcgagcagtgatgtgattttactggacgattattatccggaaatttataaaccgacctacgataagaatgttaaggtcattcaggtatggcatgcctgcggagcatttaaggcactgggacttgagcgtatgtcaaaggcaggagctccgccgatcaatacgtcggtgcataaatgttatacccatgtaccggtcagctcctatcattcggcactgcatcatcaggaagcgtttggtatcggtatcgataagttttatccggtcggaattccaagaacagatattttctttgatgaggattacaagaaaaaaacctgtgaacgtgtatatgcggaatttccgggggcaaaagaagcgaagcgtgtgattctgtatgcgccgacattccgtggaaacagcgctgtggatgcacatttcccgatggaaaaactggattttgaagagtggggagaattatgtaagaggacagattcttacctcatagtaaagatgcatccatttgtacaggagaaaatcaatattccggaaaagtacagagactgcattgcggatgcggcacagtatcgtgaagtcaatgatattttattcattacagatttgctgattaccgactattcatccattatttatgaattctctctgctgagaagaccgatgctgttttacgcatttgatcagatcatgtatgtttctacgagagatttctatgagccatatgaggatattgtaccgggacgtatcatcaagcgttttgatcagctgatggaagctctggagaaagaagagtacgataccgacaagattgaatggtttattaaaaagaatttcgcatacacagacggaaaatcaacggatcgtgtgattgatctgatcgtaggggatgacaaagagattaaaaagtattcggcggcatccatgcagggagcacttgcggcagtaagcaataatttcggaatgaatggagaacatgtagacaagcggtatcgcgatgatgaccgttctgtcgtgcagaaccgcggggaagcacaggaaaaagattccgaaagtcagaataacgataaatattcagagtaaaaaatggaggaaaatttcgtgagagaaaaaggaaaaattgcagcatctattatgtgttcgggatttgatcaggtaatggattatgtacatgaatttgagagaaataatattgaatttttacatgtggatgtcatggacggtacgtttgtcccaaaccttgcatatggtccggattttgtaaaaagactgcgtaagaaaacagatattacactggactgtcatctgatggtagaccgtgcggaagataagctggactggtttgatttccagccgggagagcatgtgtccctgcactatgaaggaacctgtcatatccagaagtgcctcgatcatcttgcaaagaaaggggttaagccggtgattgccattaatccgggtacaccgatccaggtactggaggaaattgcagattatattgcgggagttctggtgctgcacgttaatccgggatttgccggacagaaaattgtaccgcataccattgaaaaagcagcacgtattcgtaaatatctggatgatctgggacatccggaggtatatattgaatccgacggaaacattacctgtgagaatgcagcaaaattatacaagaatggttcggacatttttgtagcaggtacaagcagtattttccgggagggagatatcgatgaactgattatgaacttaagaaaggcaattgggtggtgagaaaggagacgtaatgtcaagaatttattatagaggaggaatgtctccatttgagacattttccccgggatatattttgacgcataatgttattggaaccaatgttggtaattttttatatttaaatggggtattgcgttcattgatgatcgacgacaatacagtaattcaggcaaattattataatacaaattattataaacctgaatatgttaatgaaaacttcgattgttttgtcattccattggctgatgcgttcagagagaattttgtgaatgaattaaatgaattaacttcttttgttaaaaagttaaagattccatgttatgtaattggcgttgggttaaaggaatcctatgaaccggatttttcacaacccaaaccacaggatgaagctgtaaagaaatttgttacagcagtacttgaaaaatcaaattgtattggggtaagaggtgaattaaccggtaaatatttggagacattaggttttgcagaaggacgcgattttatggtgataggttgtccatctatgtatatgaagggaaaacgattgcatatacaaaatccgaaattagatgttaattctaaagtatgttttaattcaaatgttgcagcttctgttcctactcgtaagtttattaaattaaaaatgaaggaatttgaaaaccattattttattggacaagttgtaaatgaactcagaagtatttatttaggtgctccatatgaatataaaatcgaatataattttcgtaacgttacagataaaatttatcaggatggtcgattgagatttttttgtaatgtacctaagtggatggaattcctgaatgattcagatttgacttttggatcaaggttacatggaaatattgcagccgttttagcaggaactccagcattgcttgtgacgaaggactcaagaactagggaattggcagagtatcatcatttaaatgcgatacatgagagtaagctgaatgaaaaactgacattgcaggaacttgtggaacagcaggatttttcacagattgaaaaatatcagaaacagaatttcgacaggtatgttgcatttttgaaaaagaatgatatcccaaatatttttatggacggagaagatccgcaggaaactgcatttgacagaaaaataaagcagacggatttgctggagggaatagttccggtttcccaatgttctctggaagaaattgcagaaagaaacagagattactatacaaatttggatgaaaaactggatagattatcgaaaaaattaaattttacttcggatttattacaaaaagagagaattaaaaatcagaaaattgcaacagaaccccttagcaaaaaagtcgtaaataaggtaaaaggatttttgaaatgatgcaagtatatataattaggtgtttggttttatgaaaaggttattgtgaaagactgatttccagagattattgactggcattgataaaaaatataattcataaatgtaaagcatacggaatcacatttggaatgcaatccaaaggtaatgaaatcagcaaaaataaaataagcggttgcaagagtgggaagataggcattgcaaaagacagtaatgttacgtatgtgaagtaataaaagagagaatagatgatggttcatttgttctcttttaatatgtaaaatttacagtgatcttttttagtaaatatggtatattaaaaatgttttacttggatttcacataaatgaaaggacgtatattatgcgaaagaaaggaatttgttttggattgattctggctttattacttccgtttgtattcacaactgaagtaaaggcatcagataatacagaacttaatatttatgcattttatcttaattcagaaaaaaaaggggattctacactgttagaatcgaaaggacattatttgttgattgatattggcgcagacaatcacgcacctgcaatcattaaacagctacagacattgggagttactcatgtagatgtgatgtttagccatttgcacacagatcatactggaggatgttctacggatttacaggctggattgaagcagtttgcactttccgggattacgattgatacgttatatctgccagacccttcgctggcggttttatcaagaagttatccatcccgctatgcagcatttcaagcatttatgagcacacagggaacaggaagaattgtatatctgaatgttggggatcaggtcaatgttggtgatgcgactggaaaagttattgggccagtaaacacgaatgagatttccccatatgcttataccagtattacaaaagaaaaagaacgttttatacgttatgaaaataattgttcacttgcagttatttttacctgtggaaatacacgttattttacagcgggagatagttattctgatgaatcggatcggttagtctcacgttatggtacgtctttaaaatgtgatattatgaaaatgaatcatcatggaattggaagtggaaattcagtgtcattattggaggcggtacagccatcttatgcttttattccgaacactggagtttccgagacagatgcgaagacgaataaatggcgtacaggaacagcgattaagcgcatgacatcttatggtctttgttatttggtgggaaatgaagagaaaacattgattttccatattgagaatgataagattacactatatcgcggagatactgtagaaacaggtaaaaaaatgacaggatggcagtcattatatggagctgatggtctctaccgtgaccacgatatgtattattttgataaaaatggttcattgtctaccggggttaaaatgatagggaaacactactattattttcgcaaaggtggacagatggattatggaacctataattcagagggaaattactcgggatggcatagttacaacggaaagaaacgttatttcagattgtctgatgatgaaaattatgcatatatggatgtcggcagaaagaaaattggaagtgaaacctattattttgataaaaatgggtataaattaattccggatattgttggtgatgatgaaaatgttgaggatgatatctatccgacacagataggatctgattattattatttaaatgaagatggagcaatgacagaggatgactggattaatatagacggggaagattatttctttgggaaaaatggaaaaatgtaccgtaacggagtgtatgcaattgcaggagataattatctgtttgaaagcgatggaactcttgctgtaggggattctcatacggaactttatgattttaagaatagtacatatgctgttcgggcagatggaacattagtgtcgggaaaaattgcaaagattgacgggtatcaatattattttaactcaaaaggaaaattacaaagcaataagattattcatgtgggaaaacataattattactttggtaaaaatggagtactaattaaaaataagaagattaaacgaaatggaaaaatttactatagcaataaaaacggtgttttgtcgaacaagaaataattggggatgacatatgaaaaccaaagagaaaaagaaaagcaaatggaaaatgatcgcagggattatgcttgtgatccaattgttactgagcctggcaacggtcggagttgttttgtggctgaatattgttccaacgctgtatgtgatcctgcttggattaagtctgctgctgctgctcattatagaatattgtctgttttattttggtaaaaagaaaaagaccggatgctatgtcaggcgtacgcttggtgtaattcttttccttgcatgtgtgattgtgtgtgtgggtggttcctatatgcttgtaaaggccggaaatacgctcgataatattgccggaaatgtaaagaccaccgataccgtgtccgcctatgtgatgacggatgatccggcgcagacactgatggatgcaaaagactatgtgtttgcaattaccgaaaaatacgattacgaacatacccaaaaggcaatcgaaaagatcaatgaaactgtcgggacacagatccgtacacaggtgtatgacaacattcctgatatggtacaggcattgtatgagggaagtgctgatgcaatgctgatgaatgtggcatatgtggatgtggtagaggcacaggatggatatgaaacattttcttcaagaacaagaacactgtatgaccatgaagaagaaaatgtggttacggaagattcacagactgcagaaaaatcaattacaacagatccgtttgtggtttatatcagtggttcggatactagaaaccttacacttactaccagccgcagtgatgtcaatattcttgcggttgtcaatccgtccacgaagcaggtgcttcttattaatacaccgagagattactatgtggatacggcagcgtcagcaggagcaaaagataaactgacccattgcggaatgtatggaattgactgttccatggcaacacttggaaatctgtatgatgaacatgtagattattatgtgcagatcaattttaacggatttaagacacttgtggatgcggtggggggaattaccgtagaatcggaaaaggctttccgcaccagtgagggtggattttatattaaccgcggaaccaatcagttaaacggcacagtggcactttcctatgtacgggagagaaagtcttttgcggatggggacaattccagaggaagacatcagatgcaggcaatcgaggcactgattaaaaagatttcttccggaacaacggtgcttggtaattattccgcaatcatggacagcatgtcaggaatgtttatgacaagtatgagctcgtcagatatttccgcactggtgaaaatgcaattatccgatctggctgcctggaatgtaaagtcttatgcagttacgggaacaggcggatcatcgaccacctattccatgcctacgaaacgaagctatgtcatgtatccggatgaggtgcaggtaaaatatgcagagcagcttgtcaataaagtcgttgagggacagatcctgacagatgctgatctggagattccggataatatcgtacagtagtggaaatttacagtgaggaaaagatatgaagttccgagaacaaacagctaagaaaaagagtatccggcagatcgcggggatgttcctggcagttactgtgctgctggcggggagtccatatatcgcagaggctgcagagattgtcaaagatatggatggaactgcatatgcgcaggatgcggcaggatttgtctatcagattccaaaaggtgcaacaacgaaaaaaggctgttccatttatatgtatacgggagaaaaaagcacagttacctttcctgcaaaatgtaattcctacgtagttactaacatcggaacgaatcttggccagctgattctgacaaatttgcagacggtaaagattccatcaggatataccacgattgaaacacaggcgtttcagaatcagacggatttgtaccaaattgagattccggccagcgtaaaaacgattggagtagatgcatttgcaggatgtaacaaggcaaggcttacgatagttactccgtatggttctgcggcggaaacgtatgcgaaagcaaacgaaattcattatagcagtcagacatctttacaaatacaggcagggtatagtaaactgtatgtgggagagagccgatccattgtcgtattgaatgcttctgtggcacccgtctggaaaagttcaaatagcagtgtggtatcggtagatgcggatggaaggctgacggcgaaaaaagccggaactgtaaaaataacggcaaccattggcaaaaaaacttatacatatccctatacggtgattgcgcgttcccagaaaaacgtgcttgatattatctggaatcagtatgtgacctccgggatgagcgattatgaaaaggcagttgccgcccagcagtggatgcagcagaatgtttccccgaatggaacatcggttctggcacagaaagcactcgagcagggcaaggcaaattataaggggttttgtgaagcttatcagttgattatgaagcactatggcatatccgcaaaagtggtcaacggcaaaaaacacatggaaaattctgtcgtgatcgccggtaaaaaatatacagcatcaacgctggaaacttcagcgaatgcagataaaacatatactacaacaaccatcccgggacttgcggtgaaccgggtaaccatggttctttccaaaggcaggaccggcacgtttaaagtgaccggacaaagcaaaggaattacctggtccagcagcaacacgaaggttgcggtagtaaatgccagtggcaaagtgacggcaaagggtaccggcacagccaaagtaacattgaaagtaaacgggaaaacatttgcctgcaccgtttgcgtaaatccatgaaaagattgaaaggagaaattgaaagaatgaaaaaagtaatgaagagggtaattacggcatgtctggcttttgccatgattctggcgctggtgacaccggcatctgtggaggcagccacaaagaatgagagcttaacactttataagggagaaacctatacctggtaccttaccggtgtgaaatctttaagcagtgcgtcaagcaccaagaaagcagttgcaacagtaaaagccaataaatcgaaaaagcagtataccatttctgcaaagaaagcaggaacttcggttgtaactataaaagggaaagattattacggacatacgcagtctttaaagataaaagtaacggttgcggagccgaagtttgaccttaagcttcagaaactggatggaaattatattctgatccgtgtgaaaaacaatacgaaggcaacgtttgaccggttggcggtacgctactcattaaagaacagttccggatctgaggttgcagcaaaagatgagattgtttatcgtgtaatgagtggaaagactgcatacgaaagtatttatgtctcatctgcggcagatgttgatatttcgcagtccagtgtaaagattacggcatttgacagaaatccggaacagaaatataaagtgctgggaaaagataagctttccgttactgtcacagatgaacaggtatcagattccagtatttcatttaagctgaaaaaggtaaacaaaacaagtcagtatgtgtatggagaaatttatattatcagctatgatgcaaacggaaccatcatagatgtatctaccagctccttatacctggataaaaaggaaaccaaaactacttcggaaaccgtttccaagagcccttacagccatccgaatttcgaccattatgagatcgtatacggtggatactatacaacaaaataaatttcggtcattcttagatgattataaggataagggtggaatcattgtgattctgcccttgttttattgaaaatgagggtgacaaaataaaaaaattcagaaaacggttaagaaatggcaaagatgtccgatatatattgtgtaggtaaacaaaaagaacgccaatcatggaagggaggcgcgttaccgcagcaatcaaggatagatatcagacaattgtacccgtaggaagcattatcgcgatcacttatcattctccgcgtgagaatcatggggaatcacagatgaagcagaaaaaagcatcgtttgcaggtatgctggatcagcagatgcagatgctcagtgttggaaaggaggaaaattcaacatttcagatatattgctagaacataacgaatgaacgccgtgtcgataccagtgtgtacgatgcggcgtttttgtgttatgataggaataaacaaattttataagggagtacaacatgatcagaaatataatctttgatgtgggaaaggtcctggtttcctacgagccggatgcgtatatgcagcgtctgggaattagtaaagaaaaacagaaaaaaattaatgaagcaatgtttcaaaacaaattgtgggatacgtccgatcagggacttgggacaccggatgaattcttacagaaatttattgcgggagcacccgaactggcagacgaaattacgaaaatccataaaaccgtcggaaataccgtggaactgttcccgtatgccatggaatggattctcgatctgaaggcaagaggatatcatgtgtatatcctttccaactacagtgaaaacatgctggatcagacaaaggataaactgaaatttcttccgcttatggatggcgttgttttttcatataaaataaagaaaatgaagccggatccggaaatttatgaatatctgtgtgatgaatactggctggaaccggaagaaagcgtatttattgatgatcgtccggtaaatataaaaggagcagaaacctgtggcattcatgggattgttttccggtcctatgagcaggcaaaaaaggagctggatgagtttcttaaggaattctaatatttctgcgaaaaacttttcaaaaaaccaagagtgtgataaaatggcatacagcaattggttttaaaagttgcgagtggagagaatgaaaaatcttgggcgaggcataggggatatgtatcgcaaggagtgcagatcaggaggataggaaaatcatggattacagacaggaatatgacaagtggtgtaatgacccgtatttcgatgatcagacaagggaagaactgaaggcaattgccggtgatgacaaggagatcgaggatcgtttttatcgtacactggagtttggaaccgccggattgcgcggggtgatcggtgcgggaaccaatcgtatgaatatctacacggtccgtcaggcgacacagggactggcaaactatattctggcacagggaggacaggagaaaggtgtggcaatcgcacatgattcccgtctgatggcagatgaatttaccgatgcagcggcgctttgtcttgcagcaaacggaatcaaaacatatgtgttcaagagtctgcgtccggttccggaactttcatttgctgtccggacactcggatgtattgcaggtattgttattaccgcaagccataactcgagagaatataacggatataaagtatactgggaagacggcgcgcaggtaacaccgccacatgataccggtattatggcggaagtagcaaaagtaacttcttttgacatggtaaagaccatggagaaggaaaaagcacaggcagaagggctgtatcagatcatcagcgacgacgtggatgaatcctattttgcagagctgagaaatttatccattcatccggagatcatcaaaaagatggcaaaggatatcaagattgtttatacaccgttacacggaaccggtcttggtccggtcaagcgtgtgctgagcgatcttggatttgaaaatgtatatatcgagccacagcaggcagttgccgacggacatttcccgacggctccgtatccgaatccggagaacccggatgcatgggaacttgcattaaagcttgcgaaggaaaaggatgcggatctggttctggcaaccgatccggatgccgaccgtctgggtgtatactgcaaggatacgaaaagtggcgagtatgtgacatttaccggaaacatgtctgcaatgctgattgcggaatatattctgggacagaaacgtgcaaataatacaatgccggagaatccggtactggtagaatccattgtttccaccgacatggcaaaggcaatcgcaaaggcatacgatgtggagctggtagaagtactgaccggatttaagtatattggtgagcagatgcttaaatatgaaaaatccggagaaaagaattatgtgttcggatttgaagaaagttacggatgtcttcctggcacttatgcaagagataaggatgctccggcagctgtatgtatgttgtgtgaggttgctgctttttacaaatcacagggaaagacactttgggatggcatgatcgatatgtacgaaaagtacggatattaccgtgagggaatcgcaaccatgacacttaagggaatcgatggtgccgcacagattcagcagattatggatcgggcaagacagagtactccggcaaagcttggagcgtttgatgtacttgcagtccgcgattacaaggcagacacccgtaaggatttaaagaccggggaggtgactgctaccggacttccgtcttccaatgtcctgtattatgagttatccgataatgcatggtgttgtgtacgtccatccggaacagaaccgaagattaaattttatgtcggtgttaagggagataccctggatggtgcagatcagatgctggaagaattaaaagcagaagtgttaaagcactttgaataatcggtagacagttatgatgaaaatatacatttgtccgcaatgtggatggctccgtatggtttccagacgaaaagatgtcgaatgtcatcagtgtgggaacgcgcagatgcggctgaccaatctcgacctggagaaatatacttccatgtcggaacaggaccgcatcagttatgcagacgcatggctgtatatacacaataggcaaaaggattaaaaaaatggcagataatagaagaagaaaaaagagaagaaagaaaaagaagagcagaaagattgtattgtttgtatttgaaattctgcttctcgcaatcctgcttgtcgctgcgtattttattggcatggtaaatcgtgtgaaatatgaaaatatgagtgagacagaggcaggaattaatgatgatctcagcaaagataccttggagtctttggaaggatataccaatattgcagtgtttggtctggataaccggagtgcaaataactaccaagagggaaattccgatgttgtcatgattgcaagtattgataataagacaaaaaatgtcaaactggtatcggtataccgtgatacatttctgtcagtcggaggcggcacttatttcaagtgtaacaatgcttatgccagaggcggggcaaaacaggcggttcagatgttaaattccaatctggatctggatatcaaggaatatgtgtgtgtggactgggcagctgtcgtagaagtgattgatgatctgggaggactggatctgaatattacccagggcgagatgaaccagatcaacaagtacaagaaagatgtggacggcgtaaccggaaagaataccccgaatgtgacgcagtatggtctggtgcatctggacggaacacaggcaaccacatatgccagaatccgaaaactttccggagatgactttaaacgtgcatcccgtcagagaattgtgctgcaggcgatgctggagaaagcaaagaaggcaaatccggcaacacttgtcaaaatctgcaacagtatggtagatgatatttccacaacactttcgctggatcagatggtgagtctggcgaaagatgtaaccaagtacaaaatcagcagcaccactggttttccaacagatctgactacgaaaaacatgccgagatgcggagatacggttatcccggctgatcttgtgacgaatgtaaaaaaactgcatgaatacatgtttgatgatgccgcgtatacaccatcacagacggtgcaggcaatctctgaaacgattgtaaatacaaccggaatcacggcagattctgcaaaaattaacacatcggattataacgagacagtaggtgccacaggcacggatgagatccagaagggatcagaaactactggcggaacaaatgtacagtaatcaattgggaaataagagtagaccaatcggcatgattggtctactgttgtcattggagaggaaaatcaataaagataaaggagaacgtttccatgaacgaacaggtaaagaaaaatattatggagtataagcagaaatatttacagaaactgacagatgcacaggtgccggagaaactggaaaaacagctggaggaaatggactggacctgtctggaactgattcatcgaaaaaaacagcaaagagggacgtttgccccgctgcaggcggccgagctttccgaaatccgaaagaaggaagatctgtatcgggaaacgggactgaaagcacttcgggaaggaaaagtcggtgcgattcttctggcgggaggacagggtacccggctgggatttgacaaggcaaaaggcatgtttaatatcggagtgacgaaaacactctatatttttgaacagctgataaaaaatctgatgcaggtaaaacatgaggcaggcgtgtggattccgctttatattatgaccagtgaaaaaaacgatgcacagacacgggcgttttttgaagaacatgattttttcggatatgacagcagttatgtgaaattttttgtgcaggaaatggttccggcggtcgattttgatggaaacatactgatggaatcggaggattctctcgcgatgtctccgaatggaaacggtggatggtttaaatccatgcttcgggcacatctggatgaagatatccggacacgtggaattgaatggctgaatgtttttgccgtggacaatgtattgcagaggattgcggatccggtgtttgtcggggcaacgattttgtctggatgtgtgtgtggttcgaaagtcgtgcgtaaggtttctccgtatgaacgtgtgggtgcaatgtgtctggaagatggaaaaccatcgattgtcgaatactatgaactgacaccggagatggcagaggctgtcaatgaaaatggttcgctgctttacgggttcggtgtgattttaaattatctgttccgtgtggataagctgatggagattgtaaaaacaaatcttccgatgcatattgtagagaagaaggttccgtatctggatgaaagcggtcagctgcagaaaccgaaggagccgaatgcctacaaatttgaaacactcatactggatatggtgtatatgatggataattgtcttccgtttgaggttgagcgggaaaaggaatttgcaccggtgaaaaatgcgctcggaactgattcggtagagtctgccagagaactgttaaagaaaaatggcattgccatttaacagggatttacaaaatttacagaactttgtcacaatttgaacacagttgacaggtagaattctccttagaaaacaggaaaggagtttttcattatggataacaactattataacaatatggatcaaaatcagaatacacaaaataatcagaatgggtacaatccgtacaacagcaacagtcagggacagacatatcagaatacatcatacaatgcgtacaatccgtatcagcagccgaccggaggtccggcaccccggaaaccgcgtcgcaggtccggattcggagctaccattggtaagtgtgcggcagttgctctggtctttggtctggtagccggaggtgtatttaccggagtcagctatgtaggaaccaaagcgctgggagtttccggacagaatgtaagcagttcaaagagttcttcttccgcaaaagtcagccagacgagtaccggcaatgcagcggatctttccgatgtttccgcaatcgcaaaagaggcaatgccgagtattgtggcaattacaaataccggaacagtatcctatcagacattctgggggacacagcagcagcagagtgagagtgcagggtccggtattattatcaaacaggacagtaaatatctttacattgcaacaaacaaccacgtagtcgcagatgccgattcactgaaagtgcagtttgtggataacgaaaccgtagaatgcaaggtgcagggaacagatgcttcggatgatctggcggtagtcaaagtagcattgagtgatattaaggattctacattaaaagaaatcaaggtagctacggtaaacgaggacaccgataccttggaagttggtcagggcgttatcgccatcggtaatgcacttggttatggacagtccgttaccaacggtattatcagtgcgttaggaagaaccgttaccgtgcaggatgaacagaccggagagaccgtggtcaataacaacatgatccagaccaatgcagcaattaaccctggcaacagcggtggtgcgctgctgaatgcaagcggagaggttgttggtatcaactctgcaaaatattccgatacgagtgtagaaggatttggttatgcaatcccgatgtcagatgccatgccgatcgttgaacagctgattgaaaaaggacaggtagatcagtcaaaggctgcattcctcggtattcagggacaggatatttcctccagtgttgccagtgcttataacatgccgcagggtgtatatgtatatcaggttgtttccggatcaccggcagaaaaagcaggacttcgtcagggcgatattattacagaatttgacggtcagacaattacaggtatgacgcagctgaaacagctgatcgcatcccacaaatcaggggatgaagtaaaaatgacaatggaacggctgggaaatggctacaaggaaaaatccattaccgtgacacttgcagcacagtccgattttgtatccgagagcagttccgataattccaatgattctcggaactcacaggattccggtaactccggcaattccagaaactcggaaaattccgataattccggcaactccggtttcttcgatggatttggtggatcaaataattaatgacaaattgcataagatgcgctataatagattgtccgaacataattcgggcaatctattttgtattttaaagcaacactgcctgtggcagcagacaatgctatggggtagttgcagttttagaaacaggagtcagacaaaaatgaataggataaaagatttgatcattcagttctgcaagtttggtgcggtcggtggattgtgctttggcattgattatggactgatgatctttttgacagagacacatatcatgcattattttgcatccagtgccgtgtcgtttaccgtatccgttattgtgaattatatcctgagcatgcgttttgtttttactggaaaggaagacatgacgaaggcacaggagatggttatttttgtggcactcagtatgatcgggcttgtgatgaaccagatgatcatgtggtttgccgtagaacatttaggaatgttttatgcagtagcaaaaatattctccaccatgttagttactacgtataattttatctccagaaaaagattcctggaagcataagccggggttggagagttaggaggatgtatgaaaaagaaaagaattgtaatcgcattgggacatgaagctcttggaagtacactgccggaacagcagaaggcagctgcgcgtactgcaaaagcagttgcggattttatccgcgaagattatcaggtggttattacacacagcaatggaccgcaggttggcatgatccatacggcaatgaacgaattctgccgtctgtatccggaatatacagcaactccgacttctgtctgctctgcgatgagtcaaggatatatcggatatgatctgcagaatgccatccgtacagagttattaaatcgtggtatttataaaacagtttccactgttttgacacaggttgtcgttgatccgtatgatgaggcattttatcatccagccaaagtgatcggtcgtgtgatgacaaaagaagaagcagaggaagaagaaaagaaggggaatcatgtgacagaggtggaaggtggataccgccgtattgtggcatctccaaagccaatggatatcgtggaaattgatgcaatttccgcactgtccgatgccgatcaggttgtcattgcctgtggtggaggcggaatcccggttctggcacagaacaaccgtctgcagggagccagtgctgtcattgagaaggatcttgcagccggaaagcttgcagaacttctggatgctgatatgctggtgatccttacgagtgtagataaggtttgcctgaattatggcaaagaagacgaggtaaagctggataccctttctcttgccgatgcaaagaaatatcttgcggcaggagaattcggagaaggaaccatggcacctaagattgaagctgcaattgacttcattggagagtctgcgatccgctctgttcttgtaaccaaattaaataaagaagcaggagagattaccggtggtatgggaactctgatcaagaaatagtagttttttgcaggaggcacaaaatgaatcgaattaagagttttacaatcaatcacaatcttctgatgccgggattttatatttcccgtgaagatggggatgtgattacctatgatctgcgtacgcgcaagccgaacgcaggagattatatggacaatgcaacaatgcattctctggagcatatgtttgctacctatattcgcaattccgagatgggaaatgaagttgtttattttggaccgatgggatgtcagaccggattttatctgctggttcgtaacagcagaagtcccaaagaagtgtttgccatgacaaaagaggttttgagacagatttatgatcataaaggagaggtattcggtaagtctgcaattgagtgcggacattatgaaaatttatctctcgcagcggcaaaggcagaagcggcaacctatcttgctgtgctggaagaacagacaaatatggattttacatatccggaataaaacagattgtaggaggaaaagatacatgagaatcggagtaattggtgcgatgcagattgaggtggataacctgaaagcatccatgagtgatatcagcacgaaagaatacagtggtgtcacctatgtgtgtggaaccattggggacaaagaagtggttgcagcagtgtgtggaatcggcaaggtgtttgccgcaatctgtgcggaagcaatgattctggagtttcatgtggattatgtgatcaatatcggcgtgggtggcacactttgcaaagaacttggggtaatggatgttgctgtggcagataaggtagtgcagcacgatatgaatacgacacctctgggagatcctgtcggacttctttccggtatcaacgaagtgtatctgccgacagacgaaaaaatgtgcagactgctgggcagctgcctggcagaaaaaggaattcactatcatgtcggaacgattgccacaggggatctgtttgtcagcacaccggagcagaagacaaagattcatgagaggtttgatgcgattgcctgtgagatggaaggcggatctatcggacatgtctgctatgtaaataaagttccgtttgcgattttacgttccatttcggatggagagggtgcttctatggattatgcaacatttgcagagaaagcggcactgcagtcaattcttgtggtgattgatttcattcagagagcggatgagttgcaggcataaactgcttctaaatttttgaaacggtacatatactctacaaagactttttggtggagttgttatgttcaaaaaaatacatcgtgaattaaaaaaagagtcatgcaggaagatcggaaacggtcttcttgtcatggctcttatttgttgtctgatgtttgtttcttatcaggcgacatctgcagtgatcacaagcgctaccgtgggggatcgggagcttccgatttactgtgttgatacaacggaaaagaaggtggcactcagcttcgatgctgcatggggagcagaagattttccgcgtatcatggatgttttggataaacacaaggtaaaagtgacattttttatgaccggaggctgggtagaagataaccctgattgtgtgaaagagttggtaaaaagagggcatgatctgggaaaccacagtgagcatcattatgacatgacgacaatttcccaggaggaaaaagacagtgaattaaaaactgtgcatgataaggtaaaaaaactgaccggttatgagatgtatctgtttcggccgccttatggggcttacgacaatgatgtgatcaagacggcgtacgccatgcattattatccgattcagtggtcagtggatagtctggattggaagaattatggtgtggattctattatcacgacggtttgcaaccataaagcacttgcaccgggagccattatcctctgtcacaatggagcaaagtatacagcggatgcattggatgccatgctgaccaatttagaggaacagggttacaagattgtgcccatctcgaagctgatcatgaagaaaaattatcatatggatgcgacaggaaaacagattgcggatgatgccgaaaaacaaaagacgacggaggcggtaatacattgagttgtgtatttcccggatttttggttattgaaaccaacagatatacggatttccctttgcgaaacatttctgttctatataaaaacctgatgaaagaacccaatgggatatataaaggataaagggcaaaaaatatcccggtgcgtaggaaaaatgggatatatagacgagatagtggcaaaaatgtcctgctgtggcagcggcatgggacatatagacaaaacgatgaccaaaaagtccttctgaaactgtcaaatgggacatatagatgtaaaggtgataaaaatgtcctattatgatatttacatgggacataacaaatatttttttggtatatgtccggactgacgagaaaatggggacataatataaaaattttcctctatatgtctaaatttttcacggaattcgtattccagaagccagagaagggattatgggtagaaaatatcagagcacagtaatgatacataatatttgcttctggatgaaaaagaatttcgtattgacatatcttttcgggggggggtagaatcaatatgtaaaaaatattatttaaaataaggaggaaatgattatgaacaagctgaaaaaagcattggtaatggttttagcattggcaatggttttaacatgtgctatggtaacaccggtgcaggctgcgggaaaactgaacaagaaatcggtttctatttatgaaacagagacagtttcgctgactgtgaaaggagtaaaatccgtaacctggaaaacttccgataagaagattgccactgttgataaaaagggactggtaaaaggcgtaaagaaaggcacctgtactgttacagcaaaggatacaaagacaaaagctgcatattcatgtaaagttaccgtaaaagcagcaaaatcacttggaattgcagcaaaggatattagtgtattcactggtggagaaactatttcttatccgggagaggaaatcaagggcgcaacttatgtactggatggaaagaaactcgggaaaaaggattacagtacatggacagataaggatggagagcgtgtagtttcttatgttacacttacaaagaagcttacagatggaaaacatacctttgctatccagaaaaaagggtataagaccgtgacaaaatcctttaaatttactgcattaaagattgatggaatgtttccagagggtgaagatggggaaccttgggtatccgatggtatattgtatgtattctgtacaccaaagctggatggaaaagattttgtgattaaagtagatggtacagaagtaaaacctaaggatgctttcttaagtggagatggtttttttgttatctgggtggatgctacaggactttccgcaggagagcataaggtgagcgttaccgcagaaggaattccggatggagaagcttcatttacagtaaaataatatatctgaatttcaaaggatatgaatcattgtcaggaggatgactatgaaacaaatgaaaaaactgcttgcatttgtactggcatttgcgatgatcatcacgatctatcagccatcagcggcatatgcagcaaccaaaaaaataagattaaatgcaaagacaatgacgcttcaggtgggacagaaaaagaccctgaaagtaaagaatgcagggaaaaaggccaaattgaagtggtccagcaataagaaatccattgcaaccgtttccaaaaagggagtagtaaaggcagtaaaagtcggaaatgctgtcgttacctgtaaggtaacaacaaaaaatggcaagacaaccaaactcacttgcaaggttgcggttaagaaaacagcaaaagttaccagcttgaccgttggttctcagagcgaactggaaaaggctctgaaaaataaaaacgtcagaaagatcacggttgcaacgcagggagccgttacatttacggtaccacagggcaattacagcaaagtggatctggtgatcaatgcaccgaatgcggatgttgtgaacaatggaaaattcaagtccattgatattcaggcaattaagtcgaatacttaccgcgagaatgcgaagggaaattcaattaaaattactgccgtagatgcaagaattattgttgaagcgggtgcatctttggcaaaagtttccgtaacacaggaaggtggaaaaattaaaattgaagcatcaggaacaattgatgcagtagaaatttctgcaccggttattgttgatcttgctgtagatggaaaaattggagaagtaaatgttaaagcggctgcagtactttctgtagaaggaaaaaccacaactgcagtaccaattaaggttagtgaaaaggctgcaggagcaagtgttgtgtccagtacaccggtagatgtaaaagctgccgcagatatttctcttacgctttcaaagggagcagaaggaagtaaagttgcagcaactggagaaaagacagaagttgcagtaaaaaatgatacagctacggcagttaaagtagaaacaccatctgggacacaggaagtggctacaggtacatcgtccaaggtaaattcagatggaaagaataccgaaacgacaactaccaatcctggatacacctatacttcgccagatccgttgaaactaactaatattatggttcgttcttcacaaaagattgcagcatattttaatcagacagttccggcagaaattgcgtcagaggcagtgacggttacagatgcagccgggaataaggtgaacatagataagatatacagacatcagcaggacacacaggcatattatatggaattttcagaaaaattgcagacaggggaatatacaataacaataagtatatccggcataaagtttgtaaagaaattcacatatgatggttctgtctgggcatctttggatgcagcaaagaaaattgtgcaggcagaaatggaaaagacacatatagcttcggtatcgggactaaagagtgcggaaatttgcagacatgcattcgaagaagatttaaaacaggaactgagtaaagatacagaggcttgtaagattgaaagatggagtgtgcagacccgtcctttcaagtatgaggaagaatatccagatgaaacagtagaaaaagaccatgcgatggtaagcatctgggtaggaatttataagggcgatgcaaattatatgatgaatgattttgtagattttgcctgtacaggagatgcaattacagtatcagagcctactatagtaaaacagttaaaggagtcaattgttgtttcttatgaaacgggatatgaatatgcttgtgtcacaagtggtacagcaatttctgatgttccggaagaaaaatgggacggttacgcagacagacttggaaattatgaaatcaaaaatcttacaaataatacagagtatgttttatacaaacgtctcaaaggctgctctgaaatgtatgcgcagacaacgttttctttagataaaaatgccgatgaatttgaaataatattgaaagaaccggatcagacaacaattaatttggaaactgtaacatccggaagtgcaattgcggtagattttggaaaaggaatgttgaaatatacgtatggaacagtgccggacgagttacaggaaattggttctatttcctttgaaaatctgaaaattcaacaaaatggttacgattggaacagagtaagtcaggaaaccggctggggcattgtagatattcattggaatgatgaactgtttcatgaaggaagtaatacagtaaaatttgaaatatcgtttggttatgcaaaaaatgatggaactatcgtaaaacaatcaaagtcggttgaaattacggtgaattttacagtacaataaaaagaatttagcattaaatgaagaggggctgtcgtatgaactttagtttgtatgacagcttcatttagtttatcaagatcgaccataaatatggaaatatggatttataaaaatttaatttgctatcagaatcaatatcttttacaataaaatcacatacgttcttttggggagattttttgacggggatttttatgtaagaggaggttttatttgaatacagagataaagaatgccatacaggcagctgatagtgaggcacagtatgatgaaagcgcaaagcgtctgttagcacaaaagtatgtattggctcacattttagttagaacagtggaagaatttcaagggatggaaatcgaaaaagtagtttccctgatagaaggagatccatatatcagcaaaataccagttgcgtccggactgaccaataaggacaggaatgaggaagggaaaaggattgtaggactaaatacagaagccggagaaagaaatgaaggactggttcgatttgatattattttttatgtgcgaatgagaaacgggttggcgcagatgattatcaatgtggaagctcaaaaagatgaacccggctcgtatcagattttaaatcgggcaattttttatgtaagcagactgatttcgtcacagaaggaacgggattttgtaaaatcgaattataatgatgtaaagacagtctatagtatatgggtttgcatgaatatgccggaaaacagtatgtgtcatatttatttaacaaaagaagatttactcggaaagcataattggaaaggaaatttgaatctggtaaatattgtgatgatcggcttgacgaatgcgcttccacagcgtcataatgaatatgtgctgcatagactgttatgtgccatgttttctaatgaattatcacaacagcaaaaaatgaaaattatggaacaggaatatcatattccaatggaagaaagttttaaggaggaagtgagtattatgtgtaatttgagtcagggcattaaagaagctggaattgccgaggggcgagaagccggaattgccgagggacgggaagctggaattgccgagggcaagcaaagagaaattgaaaaagtaattttaaatatgcataagaaagggtactcgttagaacagattatggatgcaacagaattggaaacaactgaattagaaaccataattgaaaaattaaaataaagcatcgcaaagacattagtaaaagtgtttacggtagttgaaagaattataagcaaataccttataaaaaaacgcataaaacagaataaagaataaaaatgcaggtataattgcataaaatatcaaaaaaggcgcagtgatttacaacattgcaccttttttgttttgtgcaaaatctctttcatacaacggaaatgtatgtgaaaagtgtataaaatgcataagaaaaacttggaattcccgtcaattgaataaacggttgcgcaagtggtatagtggacatatcaacaaaacaaacggttgcgcaacacgataggtctggtgataagggagaggatatcagaactatcgtgtttgtgtccaaagagggaggatcgtgtatgaaagagaaaaaacattggaacaggagagtgctcagttttcttctgacacttgctatggtgattacacagcttggggtgtggaatgccggaaaggagagcgtacaggcggcagatagttctgttatttattcagatgatatggaaaatgatgctgatgtagactgggatgttgtgtggaaaatatcagaaggtgttacagtggaaagaagtgcagatcagtgggcttcgaacaataaaaccaagtggtgggtgtttaaatcacctgtagaaaaccaggtgacaattaccagaaaagtaccggttacttctggaatctatacagtgtctatggaaacagcaggggggaatatttctggaaatatacagattggagaggaaaaaaatacacagtcgaaagaaattgtttatggtggatgggatgattttaaaacaacaactgatacgataaacatagaaaatgattccgaattaacgatacaaatcgaagtagatatgcaggcagaaggttggtttgatttagataattttgaagtggttaagacttcagaggagaatagtgaagatgatagcagtgacaattccactgaatacaatctgcagatcacagcagataacactacagtagaagcaggtgatacagttagtctgacagccgtactgaaaaagggacagaccgaaatcaccgatttagaagcagcagggctgcatctgtactggtggaataatacaacaaacagttccggtgaatttataaattatgatgaaagtaatggttattcactcaccttgcagacaactttaggaacgcttggaaccaacgaaattcaggcaaaacttcaggacgcagagtggaaggatattgtgataaagaaaatagaaattacagtgaacgaggcatccaacagtgtaaaagatgcaccgatcgatgtaacaaaagtaaacaatttgtcttctgattttatcatgggaatggatatctcctccatgatctctgaattacagagcggtgtggtataccgtgactatgatggaaacgaactgaaaacacttgatgatatctgcaggtttatcaaagagcagggcatcaatcacattcgtgtccgtgtatggaataacccgtatgatgccaatggcaacggctatggcggaggaaacaatgatgtggtaaaagcaaaggaatttgcagatgcatgccgcaatgccggattgaaaatgttagttgacttccactgctccgatctgtggacagatccgggcaagcagcaggaaccgaaagcatggaaagggtacacccttgaacagaaaaaagaggcattaaatacttatatcacaaaatccttaaataccattgatccgtcaaaagatgttgtggatatggtgcaggttggtaatgagacaacgggcggatttatcggtgagacaaatgtcagcaatatgtgtgtattattttcagcgggcgcagccggtgtagaaatgtacaatccggatgtcaaagtcgtcatccatgtggaaagcccacataaaggaaccatggtaacatgggcaggaaatctgcaggacaacaatgttgattatgatattcttgccaccagttattatccatactggcacggaacattagataacttaaaacagcagtttgaaacagtaaagaatacatatcataaagatgtgatggtagcggaaaccagttatgcttatacgttagaagacagtgacggacatgccaatacagtgcgtgttggaaataatgataacggagctgacacaacggagccgtttaccgagcagggacaggcaactgcaatccgcaatctgatcaatacggtaaacgaagcaggaggacttggggtatattactgggagccggcatggctgaccgttggaaataccaaaggacttaccggagatgcatacaatgcacaggtaaaggaaaatcaggaaaagtgggaaaaatacggaagcggatgggcttcaagttatgccaacgaatatgattcgaaagatgcaggcaaatggtacggcggttcggccgttgacaatgaagccatgttttatccggatggcacggcaacccctgcacttcatgtatggaattatgtaaaaacaggggctgtttcgaatctggtcagtgtagaaggttttgattctgcactgaaacagacgattactgcaggcagtgattttacacttccggattccgtggaagtgacgtattccgatagcaaaacaccggtagcagaggcggttatctgggatgaagcatctgtaaaaaaggcggatctgtcaaagcccggaacttatcagattccaggcacggtttctttgagcaaagaaattacaagaggtgcttacaaaggaaaaaccagtgtagatgttacacttactttacaggtaaaatatgcaaatctgattacaaataaagaagcggttgaatttgacagtggagaatactttaccgtagacggagccacgttcaagggaattccttccgcagagaatgcaaagagcggaaaaaacagtatgggctggtacggagcatccgcagcaaatggttctgttacatataagaaagcaattacgctggaaaaaggaacctatacattggaagcatatgcccagggggcacagtcagatgtaaccatgcagatattaaacgcagaagatgaaagtgtattatttaccggcgaagccacagcaatgaccgcatggggagactggcatacaccgaaggtaacttttacactggataagacaaagagcgtaaaacttcgtgtatgtgtagaacatgaggatggcggatggggagcagtggatgtgctgtatctgcataaggatgcatcatcttcggaaggaaaggatgatacaaatacttccggcagctcatcctccgatagctcatcctccggcagcgctgcaaccgtcactccatctgatgatacaaagaaggatgacaagccagagcagacaaccgaatcaaagaacgtaacggcaacgactgcttccggggagaaagcagaagtaacggttaccgtgacaaaagatacggctggaaaagtaacggaagcaagtgcagaagtgacaggtaccaaggcagagatttctgcagatatggtgagcaggatcgtggaaactgccggaacagaccatgtggcaattactgcaaatgttaccgataaagaaggaaatatcagatatacagtaactgcagatgcaaaagacttaaccgcaggtaaaaaactgagtgtcgttgttgtggataagaaaaccggagcgtataaactggtgaatgcaaagacgtataccgttggaaaagatggcacattacatgtgaatcttgccgcaggttcggattatcggatgctttctgcagcagaaataaaaaatgtggaaaaagcggttttaaaaacggttgccgtaaaaaagacgacagcttccatcaaagagggaaagaatacaaagatacagttaagcagtaagcttgatctggataatgtaaaaaagattacatatacatctggtaaaaagtctgttgcagcagtagataaaaacggaaagattacagcaaagaagaagggaaccgtcacgatcaaagcaaaagtaacactgaagaacggaaagacaaagacagtttccatgaaaattaaagtaaaataacattgtgaggacagtggttctgtgataaaataaaaaaaagaaattgtattctttgagacttatccgggtatcttaaaggataagacaggtgaaaaggatttggggatcaattacaaaaggagatggaatcatgtcagcaacggggttatttatttttctgattgcgattatcgggattgcggtacttggggcattgatcgcagtgattgcagcagtatccggggcatctgcagctatttcggatgaagaggatggactggaggagaacgcataaagcagtcagaaaataacggacagagtacaggaaagaaagacgttcggaaacggatgtcttttttttgtttctaaaaagaaaataaagctttcggaaatcctcttgtaaaaaagaaccgattatcggtataatgaaaaaaaacaggcgctgggaactgtgttccacttccaatgcgtctgctttattcagcagaagaaaaatttacaggaggaaaacatgatttcaaagtacagtgtgaaacgtccttataccgtgcttgtggcagttgtgctggtcatcgtgctcggtgcggtctcgttgtcaaaaatgacgacagatctgcttccggatatgagttttcagtatgcgctggttgtcacaaccgatatgggagcaagtccggaacaggtggaaagtgatgtgacagcgccgattgaatcagcgatggcaacaacgtccaacattaaaaatatcagttctgtttcctataacagttattccgtcgtaacactggaatatgagcagaatgcaaatatggattcggtggtgatcgaaatccagcagagtcttgaccaggtatccgggcaatgggatgattccatcggaacacctatgattatgaaagtcaatccggacatgatgccggtgctggctgcagcggtggataaggatggcatggatgcgaacgcactttccgattatgtgaagaatgatcttgcgccggcacttgaaagtctggaaggagtggcttctgtcactacgaccgggcagctggaagaaagcgtagatgtaacactcgatcaggacaagatagacgcattaaataaaaagattcagaagaagatcgatgaacagtttgaaaagtcccagaaaaaaattgatgcggggaaaaagaaagtagagagtggaaagtcttccatcagtcagggatcggagcagttaaacagcgcgattaatcagacgatgaatcagcagaagaagctctacaagacggaacaggatctgaaaaaacaactcgcagagttaaaaaaacagaaagcttctttggaacagatccagacaggcatccagacctttatgaagtcggatgcctacaccggaatcgtgacggtattaaaagataacccacagcttgcagagagcagtgagatgcaggcacagatcaaacaggttaatgcggttgtgaaaaagcagttttcggcgttgtcctcgcttggaatcacagtaaatacctatgaggatctcccggcggcatccgcagaagtgggaaaactcctgaccaaagtcaatacaggaatgaaaaccattgaacgtgcacagcagaaggtagagagcggaaaagtcagcctggcctcggctttggatacgttaaatgccaatgcatccatgacggcacttcaggtcagtgcttcttctaccgaactggccaatgcagcctcctccttggagagcgcacagagtaaactggatgaagccaaagatacggcgcatgattccgcagatctgaataaagtgctgagcaaggataccatcacaagcctgcttgccgcgcagaattttgatatgccggcgggatatgccatggatggggatactgagtatctggtacgtgtgggagatgccgtgcaggatgtcagcgaattaaaagacctgccgcttgtggatatgggaattgatggaattgatacaatccgcctttcggatgtggcagaaatcaaagtgacggataattccgacgagacgtatgcggtgattaatggcaatccgggcattatgctttcgatggaaaaacagaccggatattctaccggagaagttacgaatcgtattctggataaattcaaagcgttagaaaaagaagattccaagctccacctgaatgtattgatgaatcagggcgtatacattgacatgattgtaaactctgtaatgcagaatatgatctggggggcaatccttgctattttggtattgctgctgttcctgaaagatatcaaaccgacaatcgtgattgcatgttccataccgctttccgttgtcgctgcaatcgtgctgatgtactttaccggaattaccttaaatattatttccatgtccggactgatgcttggtattggtatgcttgtggacaactcaattgttgtcatcgaaaatatttatcgtctgcgcgcagaaggctattccatccggaaagcagcggtagaaggatcaaaacaggtgacgggtgcgatcattgcgtcaacgcttaccacgatcagcgtctatgcgccgattatttttacagagggaattacccggcagctgtttgtggatcttgccctgacgattgcatataccctggtagcgagtctggtcgtggcattgacgtttgtcccggcgatggcttctgttacactcagaaaaacaaaagatatccgtcatccgtggttcgatgccgcccgggaatggtatggcagagtgctggagtggtgtctgcgtttcaaaccactggtactgattattgcggtggttcttctgatcggaagtgcagcactgtcactttcaaaaggcttaaactttatggatatggatatggagacaaatcagctttccgtcacgatttctgcaaaagagggtgagaaactgacctttgaggaattaacacaggcatcggatgatgtgattcagagaatctcaaaaatcaaaggaatcaagacggtcggagcgatggctggtggagattccacgatgaatctgatgggtggaggaaatgacagcgtcagcatgtatatcctgctggatgaggactccaaagtcaaagcatcggatgtggaagaaaaaattgtcagcaggacgaaagatctggactgcaaagtagaaaccaacagttcttccatggattacagcagttatttcggcagcggtctttccgtcagaattaaaggaaatgatattgatacgctgcagaagcttgccaaagaagtggcggatgtgatgaagcagacaaagggaaccgtggatgtggacgatggtctggaagatatggaaccacagcttaccatttccgtggataaagaaaaagctgcggaatacggatacacggttgcacaggtatatcagcttgtcagtgcgaagatggcagacagcaagagcgcaaccacgatttccacagacatcaaagattataaagtctatgtgcagacacaggaacagacggatacgaaactggacgatatcagacagatgacatttacccacacagacaaagacggaaaagaaaaagagattcctcttacgaaaatctgtgagatgaaagatacgacaacactcagcaccatgaaacgggatgcacagacacgttatattacggtatcctgtggtgtggatgaagatcacaatgtcacactgcttggcaataaaattcaaaagagtatggataagctgaatgtgccggaaggctatcatatcgaaatgaccggagaggacgagacaatcagtgattccatgagccagctggttctgatgatgatactggcagttatctttatttatctgatcatggtggtacagttccagtcactcgtttctccgtttatcattatgttctcgattccgcttgccttcaccggaggatttattgctctgcttctgacagggcaggaagtcaatgtccttgcaatgcttggatttatcatgctggcaggtcttattgtaaacaacggtattgtactgattgattatatcaatcaggcaagaaaagcgggtgtttctaagcatgaggcgattatttcatccggaaagacccgggtgcgtccgattctgatgacggtactgactacggttcttgcaatgctgactacggctcttggaatcggtgacggttccgacatgatgcgtccgatggcaatcacactgattggaggactggtttatggtaccgttctgacgctgattgtcattccatgtatctacgatatgttccatcgggaaaagaacatggtagaagaggaattatagtgaatttcacagaaatcttcttgacaaaaaagagagccgcaagtaagattaaattatgtataaaaaagtgatgatggagaggagtacacatggaattcctgaaagagaaggatattcattgaagtggagcattggcagagttttcgtgcagaatgttcctgcaatggctgtaagatatccacaggatgcagtgtggaaggtagctccggaactggaatgttgaatgtggtacattgccctgtaggcattcccggatcgtccccgttaaaggacatgatgagtattacaaaggtggtaccgcgagagttttcgccctttgtgcagaaaaagaaaaggctttctgtacagagggcgtttcatttatattaaggaggaacacatgagcaaagaattaagtaaaacatacgatccgaaagatatagaggatcgtctctataagaagtgggaggacaatgggtattttcatgcagaagtagaccgcagcaagaaaccgtttaccattgtgatgccaccgccaaatattaccggtcagcttcacatgggacatgcactggataataccatgcaggatatcctgatccgctacaagagaatgcagggatacaatgcactgtggcagccgggtacggatcacgcatccatcgctacagaggtaaaggtgatccagagtttaaaagagcagggcatcaataaggcggacctgacccgtgaagagttcctggataagtgctgggagtggagaaaagaatacggcggacgtattgtaaagcagctgcgcaaacttggttcttccgcagactggcagcgtgagcgctttacgatggatgaaggatgttcccatgcggtacaggaagtattcaccaagttatataagaagggctggatttataaaggttcccgtattgtcaactggtgtccggtatgtaagacttccatttccgatgcggaagttgagcatgaagagcaggatggatttttctggcatatcaattatccggttgttggagaggaaggccgcttcgtagagattgccaccacacgtccggagacactgtttggtgatactgcggtggcagtaaacccggacgatgagcgttataaagatattgtcggaaagactttaaagcttccgatgacggaccgcgaaataccggtgatcgcagatgcttatgtagacaaggaatttggaaccggatgcgtaaagatcactccggcacatgacccgaacgattttgaggttggaaagcgtcataatctggaagaaattgttgtcatcaacgacgatgcaacgatgaatgaaaaagccggaaaatatgccggaatggaccgctacgagtgccggaaagcactggtggatgatcttaagaaagagggacttctggtaaaagttgttccacattcccacaatgtcggtgtgcatgaccgctgtcatacaacggttgagccgatgatcaagcagcagtggtttgtaaagatggatgagatgatcaagccggctgtggaaggtgtgaagaacggagatatcaaacttcttccaaagcgtatggacaagacctactttaactggaccgacaacatccgtgactggtgtatcagccgtcagctgtggtggggacaccgcattccggcatggtactgcgatgactgtggcgagatggtagtatccatcgaaaatcctggcaagtgtccgaagtgcggatgtacacatatgacacaggatccggatacgcttgatacctggttctcttctgcactgtggccattctctacgttaggctggccggaaaagaccgaggatctggattatttttatccgaacgatgtgctggtaaccggatacgatattattttcttctgggttatccgtatgattttctccggatatgagcagatgggtaaggcaccgttccataccgtactgttccacggactggtacgtgactcccagggacgcaagatgagtaaatcactgggcaatggtattgatccactggaagtcattgacaagtatggcgcagatgcacttcgtctgacactgattaccggaaatgcaccgggaaatgacatgcggttctactgggagcgtgtggaggcatcccgtaacttcgccaataaagtatggaatgcatcccgttttatcatgatgaatctggatggatttgaactccatacgccgtcaaaggatgagttacatgcagcagacaagtggattctttccaaggtgaatacccttgcaaaagatgccacagaaaatatggataaatttgaactcggaattgctgtacagaaagtatacgatttcatctgggatgagttctgtgactggtacattgagatcgcaaaagtccgtacctataaaaaggatgaagatccggtatctgccaatgcagcactgtggaccttaaagaccgtactgaccgaggcattgaaactgttacatccgtatatgccatttatcacagaagaaatcttctgtacattacagtcagaggaagagacgattatgctctccaagtggccggagtacaaagaagagtggaacttcccggcagaggaatctgccattgagcactgtaaggatctcgttaagggaatccgtaatgtccgcacagaaatggatgttccgccatcaagaaaggcaaagctttatattacatctgaggatgcagggcttcgcactgtttttgaagaaaataaggaagtatatgtaaatcttgcttctaccagcgagattatagtacaggcagacaaaaacggtatcagtgaggatgcggtttccgttgtgattccaggagcagttctttatctgccactggaggatctggtagattttgaaaaagaaaaagagcgtttgcataaagaaaaagataagctgacgaaggaacttgcacgttctaagggcatgctttccaatgaaaaattcttaaataacgcaaaaccagaaaaggtacaggaagagaaagacaagctggcaaagtatgagcagatgatggctcaggtagaagcgcggctggcacaaatgaaataaatggtttcggatttctatagcagagaggggaaaatgccatggaagatatttcaatgagaggtgcggttgtccggatttcacaggatagtatggaagcatatttgacattgcagccaccggaggccggagagggatacacattatcagagctggtgcggtatatccgcacccagcgggtaaccaatggaattgacgaagcggcgatccaggagatgatcgatggcggagtgtacatgagagatgtatgtattgcaaaaggacagccaccggtcaatgcagaaaacggccgctatgaacttcatttcaatccggatgtggatggaaaaccaaaggtcaaggaggatggttccatagattactggagcatccgtacagtggagatggtaaaagaaggtcagacaattgccacctactatccaccaaccgaggcggtaaacgggatgaatgtttcgggaaagccgatactggcagtccgtggcaagccattgcagccactccgcggaaaaggatttcactgtacagaagacggaagtacttatattgcagacctgtctggaaagattgaaatgtcaaacggaaagatccggatatccgcagtttatgaaattcccggtgatgtgggaatcggtacaggaaatgtggaatatcacggagatgttgtaatccacggtggaatcaaaccgggggcaaaggtaagtacgagtggaagtctcacggtagacggtatctgcgagaactgtgtgattgaagcgggaaaagatattgtcctgcgaagcggtgttctcggtggaaacaagaccagtattcgtgcaggtgggaatatccacgcaaaatttttcgaatactgtaaggtgaaagccgatggctttattgaagtgacttatgcattagacagtcatatgatcagttttgatcatatttatgtaaccggaaaaaagggaagtatcattggcggatatgcctacgcaatcagtggaatggatgtgaatgtaatcggaaattccacggaagtaaagacacaggtgcatgtcggagtcagtgcgcagatgcggcaggaactgtcggatctgcagaaatccattgaagaaaatggggaagtgatcaagaagattaccactgggctgaaacagtttgaactggtggctgcgcaaaaaggaattgatgtatcgaaagatccgcgcagaactgagcttcttcgtgccaaaatgaaaacgcaggcagatattgctgaaagccaaaaagcggtagatcgtctggaagaactggtcaaacgcggggaaaatgcaaagatcagtgtcgtacgcaaagtgtattccggatgtgttgtaaccattgaccagcagacgcttaccgtaaaagaactgcaggaagccgtttgtttccagaagaaaaaagaaggggttgtgatgatctctctcaagtaaacagatgcagttcctgtaatatttccgagaaataatgcgaataaatttacttgcatatccaatgcattatattataattaagatacatgggaacgcagaacctgtatatcgcaaaaaggagcaggagaaatgattaattttgaaaaagagctgaagaattttcagccgagtctggaagtagaagaagccgaggctgcaatttataaccatgatctgacagatgtaacggatattattaccgaaatattgcgtgatgtacgtcagaatggtcagcagttaggacagtaatgaaaaagaggaagaaatgatttgttataaatgtggacaggaggttggaaatgcaaagcgctgcccgaattgcggggcagatctttccgtatttttgaaagtgcgtcacatttccaacgcatattataatctggggctggaacaggcgggcgtgagaaatctttccggagcgattgtcagcctgaaaaacagtctgaagtttaataaatataatattgatgcacgaaatcttctgggattgatttattgcgagacaggagaagtggtagatgccttaagtgaatgggtgatcagccgcagttatcagccgaaggacaatcttgccagtcattatcttgatgagatccagcaggaccggggaagattggattccgtaaatcagacgattaaaaaatataaccaggcattgcactattgcaagcaggacagtcgggatctggcaattatccagctgaaaaaggtactttcgctgaatccgaagcttgtcaaggcacatcagctgctggcgcttctttatctgcaggacaataagctggaactggcaaaaaaaactttgcgcaatgcgggaaagattgatacaaataatacaaccaccctgcgttatctgcgcgaagtgaatgcaagactgaaggaaaaaagtccttccaaaaagccgaaggatgatgatctgatttcttatcaaagtggaaatgagaccattatcatgccgaagcggtttaaggaatcttcgattggggcaacactggtatatattgtgatcggactgattgtgggtactgcgattaccgcatttctgatcgtgccgagcgttcgcaacaaggcaaaagaagatgcacagagaaaactggttgaagcgagtgataccatttccacgaatggacagacaatcaaagatctggaaggacaggtggaggatctgaaaaatcagctggaagagcagacgaccaacaacgaaaaggtcaaggttcagatatccacttatgaaaatctcctgcaggcatgtgtttcctattatggatcaaaggatgtgacgactgcgggaaagacactggataaagtaaagacgaagtatctgtccgacaaagctaaaaccatatatgatgatatccatggggaggtacaggataagtatctgaatcagctttacaaggaaggctatagtttgtactcccgtggaaagtataaggacgccatcgatacattaaaacagattacggatgagcaggaagatttccaggatggatcagctgcctattatctggcgcagtcctaccggaaaaacggggacctgaaatctgcaaaaccgtattatcagtatgtaattgaaaattatccggatacggagcgggcgagaacgtcacagaattatgtagacgcacaggaataaaaaggaacacattgcattacaaaagacactacagtacaggttactgtcggtgtctttttttgcttatttataaagaagtaagggaaaggaagaggttttatatggaagcagcatatcgaaaggaagcggactgcatgattgtgccgatgccgcgggaggtggatcatcatgtggcaggcaatatgagcagggaaatagatctgctggcggaaagctggcatgttcacaggattgtatttgattttgcggggactgattttatggacagttccggaatcggtatattaataggaagaaaaaagacgatggacatgcatgcaggaaaagtgacagcggtaaatctgggagaacgggtgtataaaatatttgaaaaatccgggttgtttcagattatttcattggaagaggaggaaaaataaaatggtgcaggaaaatcatatgcaggttcattttgatgcaaaatccgtaaatgagggattggcacgcatggttgtgaccgcatttatgacaaatatgaatccgacgctggagcagattgcagatgtaaagacagcagtgagtgaggctgtgacaaatgccattattcatggatacgaagatgaaacgaaacaggtggaactgacctgtgaccaaaacggtcagcaattggtggtaacggtggaagatcacggagtcggaattgaagatcttgaacaggcattgcagcctttttttactacaaaaccggaattggaacgttccggtatgggcttttcctttatggaggcatttatggatcggattgaggtacggtcaaaaaaaggagaaggaacacgtgtggttatgtggaaatacatagaaagggaacgtgagcagtaagataccggcaaaagaggaaaatggacgacagaacatccagagggcgcagcagggagaccggaagatcaggcagcagatgataaccgagaatatggggctggtttatatggtggcgaaacgatttgcaaaccggggaaccgatttgcaggatctgacacagatcggagtgattggtctgatcaaggcgatcgaccggtttgacacttcgctatcctactctttttctacctatgcggttccgcttattatgggggaaatccggagatttttacgggatgacggtatgattcatacgagtcgccagatgaaagaacatgcaagaaaaatagcaattgtcagagaacagatgaaaaagacacaaaataaggagccgacattgcaggaactggcggaaaagacaggaattgccattgaagatctggtggtggcaatggaagcaggaagagaggtggattctttttcacgaccggtgacggaaaatgacggaaaagtgctgactttggaagaaaagctggaggataatcaccggtttgaaactccgcttctgaatcatattgcattgaaacaggcgatcgaccagctgccggaggaagaagcacagctgataaaatttcgctatatggacaatctttcccaggcagaaacagcaaagcgcatggggaaaaatcaggtatccgtatcgcgcagtgagcggaagatattggaaaaacttcgcagaaaaatgttgtagctaccacttacaggtacagggaaaatctggtataatttgcacgtaaaagatcacaaaagggagaaattaacatgggagaatatttgcaggaagccgtgttgccggtgcagtacgacaattatgtgtttgatctgtacgggacactggtggatatccacacagaggaagattttccaaaactgtgggagaaactggcattgttttttggatattacggggccatttatgaaccgaaggaattgcagaagcgctatgcggcacttgtcagcgactgtgagcgcgcgttgaaaaagacgctggaagaggacaggcattatacgcatgaggcatctccagagattgagatcggggaagtgtttgaaaaactgtatcaggaaaaagggatcgtggccgataagacccttgccatacatactggacagtttttccgtgcgctgtctaccgattatgtccgtttgtatccggggacacagcagatgcttgccagtctgaaaaaaatggacaaaaaagtgtatctgttatcgaatgcccagcgcatttttaccgcatatgaaatgaatgttttaggcattacaaaatattttgatgatattttgatttcttcggattatcacacgaaaaaaccggacaaacgtttctttcatatattgttggagcggcataagctggatgtgtcacattccctgtatatcgggaatgacagccgttgtgatgtcggtggtgcaaaaggtgtcggaatgccggtgttttatgtaaattccaatatttccccgaaaaatgatgacggaaaagaggcagactatattgtagagaatttttgtgcctggaaggaggtaaccatatgagtaaattaaaaccaggaaaagtagcaattatcggatgtggatttgtcggttctgcatctgcattcgccctgatgcagagcggattatttaccgagatggtgcttttggatgcaaaccatcagaaagcagaaggggaagccgaagatatcgtacacggaattccgtttggaagaccgatgcagatttatgccggagattatgatgatattgcggatgcagccattattgtaattacagcaggtgcaaatcagaagccggacgaaacgcggctggatctggtgcacaaaaacattgcaattttccagtcgattattccggaaattacaaaaagagattttgaaggaattcttctgattgttgcaaatccggtagatattctgacttacacggcgcagaaactgtccggttatccggaaaaccgggtaattggttccggaactgtgctggattctgccagactgaagtatcatctgggacagcatctgggagtggacagcagaagtgtacatgcttttatcgtgggagaacacggggacagtgagattgcagcatggagcagtgcaaatgtatccggaataccgctggacaatttctgtgagatgcgggggcactataatcatatggaagcaacggaacgtatcgccgcggaggtaaaacagagtgcctatgagattatttccaaaaaaggagccacatattatggaattgccatgtcagttaagcgcatctgcgaagcaatcataagagatgaaaaatccattctgccgatttcgaccatgctgcacggagagtatggaatctcagacgtggtgttaagtctgccgtgtatcgttggccgcgatggctatgagaccaaggttccaatcgatctggatcaggaggaagtttccaaactgcatgagtctgcaaatacgctgaaagaagttctttcggagttctttgccgaaaattagtttttttgtgcttgcattttttggaagaaaggggtagaataccacagtgggtagagcaaaggcgtcgtaatgtatgtacgacgcctctttttatatataaagtgtatgaccatatgagaaatatacaaatatgacatatagtttatataaaaaaaacgttttactttttataatatgacaaatataatagcttttgattcaaaagttaagaaaggaagtgaaactgttggatgcgttggtaaagaatctgatggaggagctgaattgcgataccgtctttacaatcccgctgtttggtggcattccgatctatgaatcggttgttgttacatggatcatcatggcggtcattcttcttttgtgtctgatccttgtcagagggcttaaagttgagaatccaagccgtaagcaggtagtacttgaacttgctgtttcaaaactgtatggattctttgaggacacgataggagaaaacggtaaagcgtacattccgtacctggcagcagttgccatctacataggaattgccaacctcatcggcctattaggcttcaagccgccgacaaaagacatgaatgtcacggtagcgcttgcattgatgagtatcatcttaattgaagcagcaggagtgagaaagaaaggtaccaaaggctggttaaagagttttgcggaaccgatgcctgtagttcttccaattaacattcttgagatattcatcaaaccattatcactttgtatgcgattgtttggaaacgtacttggttccttcgttattatggagttactgaagatggtggttccacccgtacttccagcaatattcagttgttactttgatatttttgacggactgattcaggcatacgtatttgtattccttacaggcttgttcatcaaggaagcaacggagtaacacactaattaactgagaaaagaaaaggagaaaacattatgtcagcatcattatttgtagcaatcggagcaggagtagcagtattaacaggtatcggagcaggtcttggaatcggtaaggcaacaggttccgcagtagacgctatcgcaagacagccggaagcagaaggtaagatttccaaagcattacttcttggttgtgcacttgccgaggcaaccgctatttacggtttcgttattgcattacttatcattcttttcttaaaataatgattacctgcgtaattattacattaagaaaggagcagtaaactatgctgagtttaaatccatgggatatcttgtggacgatcgtaaatctgcttgttttatatgcaatctttcgtaagtttttgtttcagccggtcatgaatatcattcatgagagagaggacatgatcaacaaacagttcgaggatgcccaaaaacagcaggacgatgcagcgcagatgaagagtgagtatgagaaccagttaaagggtgccagagaaaaggcagatcagatcattctcgatgcaaagacgcgtgcacaggaagaatataacaataaaatggaagcaaccagggtcgaagcagatcatatgcttgagaaagcaaagagtgatattgcaaatgagcaggaaaaggcaacaagagatgctcaggcaaagattgcagagcttgctttgctggctgctaagaagattatgaagacgggtgaagcacatgacgcaggcagcagtaaatagtgccaaggtactataccggctgtctgtcagcagagaggatgtcgagaaagcggaaaaacttttctttatgacaccgcaactgcagaaagttctgacgagcccggtcgtaccggcagcaaaaaagtatgaaattatcgatcaggtatttgcactggaaacgacagaagatgtgctggtccggtacatgaagatcatgtgcaggattggtaacatgaccgagatgcaggatattttccaatattattataaatactgggatcagatgcatcatgtggttcgtgcggacctgatttatgccgagactccgagcaaagaagaggaggccgaggcgaaagaaattctggataaaaactatccggatagtgagattaccctgacgcagagtgtggatgagtcgctgatcggtggctatgttgttaaggtgggatataaagaatatgaccacagctatgaaggacgtctgcgtcagttacaaagaaaacttacagggaggtgacccctttgggcgctattagtgcaacagatattatctccattattcagggtgagatcgaaaatatcaactgggatgaacaaagccgtgagacaggtgaggtcatctgggtcggtgatggaattgttaccgtatacggaattgatcatgcaatgtatggcgagatcgtagcctttgaaaacggagtcaaaggaatggttcaggatgtcagacagaatgagattggtattattctttttggtcgtgataccggaatcaaagaaggaaccaaagtggttcgtaccaagaaaaaagccggtattccggtcggtgatgcgtttgtaggaagagtaatcaatgcactcggtgagccgattgacggaaacggtgatgtaaaagaggatgattatcgtccgatcgagcaggaagctcctggtatcatcgacagacaaagcgtagacacaccaatggagaccggtattctttccattgattccatgttcccaatcggacgtggacagcgtgagttgatcattggtgaccgtcagacaggtaagacatccattgcaacagataccattatcaaccagagaggcaaagatgtaatctgtatttacgttgccattggtcagaaggcatctaccgttgcaaagattgtaaatacattaaagaaacatgatgccatggattattccatcgtagtatcttctacagccagtgatccggcatctttacagtacatagctccatatgcaggaactgccatggcagaatattttatgcacaagggcaaggatgttctcattgtatatgatgatctgtccaagcatgcggttgcataccgtgcaatttcccttctgcttgagcgttccccgggacgtgaggcttatcctggtgatgtattctacttacactccagactgcttgagcgttccagtcatctgagtgacaagttaggtggcggttccatcaccgcactgccgattattgaaacacaggccggtgatgtttccgcatatattcctaccaacgttatttccattaccgatggtcagatcttcctcgagagcaacctgttcaacgcaggtatgagaccagccgtaaacgtaggactttccgtatcccgagtcggtggtgcagcccagacaaaggcaatgaagaaagcatccggtagtatccgtatcgatctggcacagtaccgtgagatggaagtgttcacacagtttgcttctgatctggatgatgcaacaaaagcacagctgcagcacggaaaagctctgatggagctgttgaagcagccgctgagtcatccgctttccatgcatgagcaggtattaaccctgtgcatggcaacggacggtgtattcgataagatacctaccagacaggtaaaacagtatcagaaagatatcctggatttcatggatctgaaacatccggagatcggaaaagaaattgagcagacaaaagctttatccgatgaactgagacagaaaatcaaagatgctgcagcagagttcgcagcagaacagtaagcaggtgttacgatggcaaatgcaaaagaaattcaggatcgaatgaagagtatcaatgatacattaaagattacaaatgcaatgtacatgatttcttcttcgaaattaaagaaatctaaaaaaatgctgacggacacagaaccgtatttctttaccctgcaatctgagatgagccgtattctgcggcatttgccggatctggacagtatttatttcaggtccacagatgagattccggaagaagaaaaacggatcgcttatatggtggttacggcggataagggactggcaggatcttacaaccacaatattttaaaaattgcggaagaggaacttgcaaagcacccgaaacgtcagctgtatgtgcttggtgaagtcggaagacattattttgaagaacgtggaattgagatcaacaaacagttccattatacgattcagaatccgacattgaaccgtgcacgaaatatctctgaggaacttctcgaagattaccgtcagggagagtttgatgaaatctatatcatttatacctcaatggtcaatgcgatgcaggaagaagcagaaatcctgcagctgcttccactgaaaaaagcagatttccacaacgtggagattccgctggatgtcagacgtgaggagcttgccctgcgtccatcggcagatgcagtgatgaatcgtattgttccggactatgtggtaggatttgtttatggtgcgctggtagaatccttctcctgcgagcagaatgcccgtatgatggcgatggaggcagcaaccaacagcgcaaaggatatgcttcatgagctggatatcatgtataaccgtgccagacaggcagcgattacccaggagatcacagaggtaattgcgggagcaaaatcccagaagcgcaagaaaaagagataatggaggcctaggatgaaaacaggaaaaatcatacaggttatgggacctgttgtggacgttgaatttgaagacgaagaattgcctgcaatcagagacgctctggaagtacaaaatggtgacaaaaaatgtatcatggaggttgcacagcatataggaaataatacggtacgctgtattatgcttgcagccagtgaaggacttcaccgtgatatggaagtcattgcaaccggaagcggtatcaagacaccagttggtgaggcaacactgggacgtctgttcaacgtattaggagaaacaattgatgacggaaagccgatcggggatgctccaaagtgggtgatccacagagagccgccagcatttgaagatcagaaccctgcagaggaaatcttagagaccggtatcaaggtcatcgacttacttgccccatatgcaaagggtggtaagattggtctgttcggtggtgccggtgtagggaaaaccgtattgatccaggagctgatcagtaatattgcaacagagcacggtggatattccattttcaccggtgtcggggagcgttcccgtgaaggaaatgatctgtggaccgaaatgggcgaatccggtgtacttgaaaaaacagccttagtgtttggacagatgaatgagccgccaggggctcgtatgcgtgtcgctgagaccggacttaccatggctgagtatttccgtgatgagcagcataaaaatgtgcttctcttcattgataacattttccgtttcacacaggccggatcagaggtatccgcactgcttggacgtatgccgtcagccgtaggttatcagccgacactggctacggagatgggtgaattacaggagaggatcgcttctacaaagaatggatctatcacttccgtacaggctgtatatgtaccagccgatgacctgacagacccggcaccagctacgacatttgcacatctggatgcaacaaccgtactttccagaaagatcgttgagcagggtatttatccggcggttgatcctctggagtcatcttcccgtatccttgagccggatattgttggggaggagcattatgaagttgcacgtaaagtgcaggagatccttcagaagtataaggaattgcaggatatcattgcaattcttggtatggaagagctggcagatgaagataaagtcctggtataccgtgcaagaaagattcagaagttcctgtcacagccgttccacgtagcagagaactttaccggtatcaaaggtgtatatgttcctttgaaagaaacaatccgcggattcaaggcaattttagatggtgagatggatgaatatccggagaatgcattcttcaatgcaggaaccatcgaagatgtcaggaagaaagcagagcagatggagcagaacgcatagcataaagaacggagatcattatggcaggcaatacattctatttaaaaattatatctgcgaaccgtgtgttcttttccggaagatgccgttctctgatcgttccggaatatgatgggcagaaagaaattctggcccatcatgaggatatggtcatcgccattgatgagggcgagatgaggtttcagccggaaggcacggataactgggaatatgcagtagtcggaatgggatttgtcgagatcgtcaataaccgtgtgacacttctcgtggagactgcagagcgtccggaggaaatcgatgtggcaagagcccgcgaagcaaaagagcgtgcagaggagcagatgcgccagaagcagagtatccgtgagtattaccactcaagagcttctctttcccgtgcgatggcacgtctgaaaggaaccagcggaagaaaataaaacaataaaaaaggatgcacgttttgtgcatccttcagaccgtagacaaagtgctccgagaaacttccgtttctcggagcatttttctttcctaaaacagctcaatatccgttttcgtcattaaaatcatgctatgctcaattctgtttctattttgattcaagtttgcgaacgagcatcgtgagtttcgcaattatctatataaatctattttatttcttcctccgcaataaaatattcttcttgcatagtatcatcatcttctaaccttaaaatcaaattgtcgtgatcatacatatatctactattaaactcatattcatataacctctttaacactacacacagtaaatgttttgtcttgctatattgtgttttgtagctaaaaccatcaaaaatcactttatccattggtacaaggtattccaaacaataatatctgctatttctttcataatcccttattatatcttttctcccgattactaatgacatctgctcgatgaattcagggcatgaacgcaacgatattgtataggaattttcatgtaacatatctttcaaagcaaatccattaacgcaatagtcctcatgccctttaaaataacccattcgccatttaacattactgacatttccttcatatacacgctcaaatgtttctattttccctctatgaaataataacaaatgtccttcattcattttaaattctacatcatgttcccgcaaaaatcttgaaacagaggtatcttgagtcaataaatcatacagattatttcccactcttgaattatcgtctaacaatctgcgtgataaatgataaaattgtatctcatccaatctaatctccggcatagtcttatcaacaaaatcacttatttcttcttcaacaggtttctgtgaataataagcactatcaaaaaataatttgagctcatcttttgtaaaacccaaatactcacaaaccgacgctgctattgtttcttttgtatgtgtatcaatatacattctctcaccacctaaacacaaaaattgtacataactccgcatacactttgtcatcttcaagcttcacattgtcaagtaacaacacctgaaacaaaacatctctcacattctcaaactttaccataccacactctttttccgtaaaaccttcaatctgcatcccctgcatggcaacttcttttcttgccatcaaacaatgcgtatacaatgccatgatatacttgtctgacataagaaaggcgtatgtttcattcccttgatatgtatatcgacacttttccagattttcctgtgatatatcaaaataacatctgaccgtttccaaatatacatctccattatactgcggtttcagcttttttaaataccttctaatggtcacaaatatattatttctttccatagcggtcttggtcctcttaaatactggctttttccatcgcagatccatataaacattattaaggatattctttcctgcatactgtttgaagtcacctatccgcaacaaatatgttaatacttcaaacaatttctcctgtgacattatctcctgatacgaataatctccaaattcaatatgatccagtttcaaaggactacttccctttttaatctcccgttccattaccctgttcacatctctcattgattccatacattttcctttccacttctggacattatgtccaaaagtaacaaaaagagcagctacaaatctctcgactcataactgctctgacactgttttctattctattcctgccattactgcaaaatcgcctttcttttctaagagtgctttttgttcatctgctggcagactcttaaatatttcctcatatcccataccttccattttcctgctcttgcctgtgatgaataattccgtgtctaaccattcctgccacaaactttcaaatgttaaactcgattgacaatgccttttttgttttctcactcacacttctggacattatgtccaaaagttcccgatatcaattttattatttccataactgtattgataattctgattataacaatcatacctccgatcaacccaccaatgatacaatctagtgccaatatgccaatgcttcctgcaatacccaaattctttggaacaagaaacatactcattttccgtattccatatggacatcctaccataatccagtatagaaaataatcaaacccatctgcctttgcacataccggatagcacatgatgatccagacagctaataccagtatcggaataataattctaaacaatacccttttcatgccagcctcccccatacatatcatgctgcacttcctgctgataataatgatttattgttgatggcgcattatacagtgccgtaaccatgtatgccttaatgtttgaaatttttgttgtcgtgtctttcatacaccccatcacatactccagatgactgctcctcagctttaagaattttgactttacaagctcatagggatactcctcccccgcaatccgtatcgtagtccgctttacacatacaacctcacagatcaattcaaataattcatcatacagttccctgtcatttatttcatcatatttcatgtgatgatcgtactcaatattttctttgataatctctatgtatgcatctgctccatccatcctatcatcggtctgatttccttcaccggatggatagattggattggtataactcatatcagtataatttatatcagtcttattatagttagtataaataggggctaaatcctgaacctctgcaagttcagtttctgaacctcttgaagtctgctttttatacttctggtggttcagattctgtacctcctgaagttcaatttctgaacttcttggagtatcaatattagacttcttgaagttcaaattttgaacttctgtggattttccagtattctcaggctctttttcctcctgttccgctgacattgtggcaaagtttttcacatagataatatccggtttgccaagacctctgcgctttttttcaatcaacccaatccctttttcggaatccagctctttcataatcttgacacaggttgctttcgcacatcccaaatcttccataatcgcatccaccgtatagatgatatacgccctgttttcctcgtctagccatccatttttcatagacagtgacatccgatcgagcatcaagccatacaggagcttggcatcgctgctaagccccttgaaccgctcatccttaatcagcaaccgggggacacgataaaaagagaactggtctgcttcaattccatagtagtaatcaaattttgtattctcgtccactttttcatgcctcctttgctgcttatttctcactgtttgaactattccactcatccaatagctgatagataacattttcaatctgctcattggaataatcttctggaaaatatctgctgatcttgtctgccttgatggttacttttcgctctatcggtttcggttctgtcaggatcagccttaccatcggtaatgtcagttcatcactttttccatactccttcagccttgctgcctgtactgtcgaaatgatcacccctgtttcttcaagaacaacttgcacccactcctgttgctgttctgtcagaaatgacagctctacaccctgcacgattccaattttctttttatcgaccatatctaaaagtgcatccgataagtgggcaaggtaaatatatctttgtactgtttttgcactctctcctgcagtttccccaacctcatccagactgttgccttttccttttttaccctgatgttttacagcttcatatttcataaaataagcttttgccttttcactcggaagaatatcttccctctgaatattgctgtccaccatgataattgtagcttcatcatccgtataatcacggatgaacatcggcattgtagtaagtccgacaagctcacaggcgtgtctcctgcgatgtccggcaataatctcatagccgccatctttcattggtctggcaatgcctggcatcaatactccatgctccctgatgctttccatcgtttcctgcatcttttcatcatccagtaccttaaacgggtgtcctttgaactcatgcagttctgacaatgcgatttcctgtacctgttctgttcctgtctgcggctgctccgttccaaataaatcatcaaagctgttcaactttacctttgcggcacttcctgtcttactcatcgccaagcacctcctctgtcaatgactgataagcacttgctaccttgccattcggatcgtgcttataaatgctcacaccttccgcagaaatctccgcagctcttactgacattggaatactgttctcaaatatccgcactctgcttccataattttcaattaacagattgctgatgtctttggcataattggtacggttatcaaccattgtaagcaaaattccctcaatctccagtttcgggttgatctgtcgctttacttttccaatagttttaatcagctgttccagaccttttaccggcagatacgctgcctgtaccggaattaagatactgtccgcactggtaaaagcatttattgtaatcatgccgagtgatggcatacagtcaatcagaatgtaatcatagcggtctttctgctgttctatgtaggtacgaagcaccgtttccctgctcataacattcacaagtgaggtttccaaaccggaaagctcgatatttcccggcatgaaatccacaccttcctcatgtcttaaaatgccgtactccggttttatttcctcatcattgataatggctgccataatggttgcaagtgtaatttccagtctgtccggctcctgaatgccaagacttgccgtaagactgccctgtgcatctgcatctatcagtaaaactttctttccatgttttgtcagtccgattcctaaattgcttgttgtggtggtctttccaactccacctttctgatttgcgattgctattactttacacatgataaattctcctattctctactattttgcttttatctgctgctctttatattgcttttctgcacttccgcataagccctgtaatatttgtttgtccctttattgctataaagttctgatatctccagaacttctactttgggatgacgctgtaagattttctgaaaccatacaatgtcattcttcgttcccatcaatctgacttttaacattagtctgctcctccaaataaggcatacagttcccggttataagtcgcatactccggatagcggatctgtatcgcctgccaaaagaaaggtgcataggcacagcagaacaagtcctccactgtatactgcctgcactcgtttacctgttcctctgtttttgtgtaatcatctacactcggtgtgctgttgcaatacaggttaaatgccattcgcaccaccttcatactgccactggtctgccagccttcatgcaagcactcagtttttacacatcctgtcttaaaatcatagatgctattgatatttcttctcgtatcatcactgataccaaggcaatagcaaagtgccttgtggtacacatcctgatagcgtacctcttttaatttttcatagtagaatttttcatgtgcttcgctgataaaattgattgtctgttcctttttgttttctgctcctaacgctgtgttgttcatagtgaacctccttttaaattgaattgaaaaaggcactcctaatggaatgccctaatataaaaaatagggacactctttcaagtatccctacgttctatcaacatatctgatagttctctatttactttcatattcagaattctttgtgttcccacaaccgaggtctaacgctacaacaacagtcaccttcctcacaagctctttttccttgtgattttcagcaatcctgttgaagctgaaaagctctacaaagtgcgtaaattcaaggatttctacatatcctttctgtgtagtcctaccacagtctccacatgcaccgtattcggaaacatatccacgcactgcaccttatccacgacatacccccgcgccagcagcacctccagatcccgcgccagactcgtcggcttacacgaaatataaatcatatgatccacaccataattgataatcttttccagcgccttcggatgaataccatcccttggcggatcgagcacaatataatccggccgttcctcaatcgtatcgagcacctttaagacatcacccgccaaaaattcacagttgtccagatgattaagtgccgcattctcttttgcggcctctaccgcttcctcgatgatctccacgcccacaacttttttgcagaccggagcaagcatctgtgcgatcgtaccggtaccgctgtacaggtcataaacggtcttgtctgccagcatgtccggatcatccccgaggataaattcgcgggctgtggaataaagcacttctgctccgagagagtttgtctggaaaaaagaaaacggtgaaatctgaaaacgcagtcccaacagctcctcataaaaataatcctgtccgaaaagtacttccgttccttcgttttttacgacatccgccacgctgtcattttttgtgtggagtactccttttaaggttccttccagggaaagtgccagaagtacatctttccatccggctaaaagctgcttttctttttcttcgtttaccgttccggcatgtggacatctgccctgcttttccagcaatgcagcctctatctttgcacgctcgtccggctcctgctcctgtacatttctccaatcctgcgtcgtagtgatcagatcaactaaaatctctccggtctttactgcctttcgcacaagaagatggcgcagatacccggtatgacgcagtctgtgatagaagaagatttcctgctccctgaaataagcgagcgttgccatgagaatcgcacggaaatcgccatccacgatccggcagtcctctaccgttacaatatcgtaaaaactgccgcgcttgtgcattccaagtgccagcggtccgtccttgtattcatctccaaatgaaaattccattttgttacggtaagcaagcacacgcggactgtgtctgattggcagaaactcataagcacaggcatccccgatcgcctgctctatcatgccgcgtacctgtgtctccttgatctttaactgttcttcataaggcagactctgatacgtacatcctccgcactgtccgaaatgccggcaggtatctgcggtctcccgtggcgatttcttcacggtttccagaagccgtccttccgcttttccttttcgtaccttatttactgcaaaggaaacacgctgtcccggaatggtattcttgacgatgacgcgttctccctcgtctgtcatcacaatccctttgttcgggaattctacggttgttacgtttccttctgcaatctgcccttttttcattcttttactcctcatgcattattctgaatcttattttcttacagaaagaagggactacacaactgcagtcccttctttcttcgttcggttttctttttctgcgcaccgctcaaactgcctgaaagttctcacgcttccgacaatgattagtcctctgtcttgtctgcggaagcatccttagactctgcagccggctcatcatcctcatcctcgaagaagtcattgtcgaactcatcttcaaaatcgtcctcaaaatcatccagataatccggtgtaaagaaacgataaattccatagattgctgctgcaactgcgacaacgattccaatcacggcgaatacaatcacgaatttggaaggtttcttctcctcttcttcctgtctcttcaaaaacttattaagctttgctgcatccaaaacatcccccactttggtagatgctaaaatatcttctactttactcatgatggcacttctccttcctgcatttttaattacatccattatagcatatctttccctgttttcctatgaaaaatttgcgtttataaaaaatttatcatatcttttttaattttgcaaagcttgcaaacatcttctttgttccggctttatcgaaatctacggtcacttcatagtccctgcccccggaaacaattgccatgacttctccatcgccaaatttgatgtggcggacacgatctcccacctgataggacaatgctccacccacggaaccaaaatcacgctggttttccacctttgtatataccggttttgtggctttggaggaatggaaggtcgatccatatccctctcccacctcttttccatatccgcttccaccataactcggcaccgtccggaatgccttacgcgccttctgaaatgtggactgttcgatgggttcttcctttgtctttggctcataaatctttccggaaagaagttccggcggaatttccctgacaaaacgggatacttttccatactgtgtctgcccccgcaccatgcgcacacgcgcggaagtgattgtcagatttttctttgcacgggtaattcccacatatgccagacgccgttcttcctcgatctcggcctgggagttatcactcgtaatagacatataactcggaaacagtccgtcctcaagtcctgccagatagacattcggaaattcaagtcctttcgcactatgtaaagtcataagtaccacatagtcactgttttcgtcaaaactgtcaatatccgcaaccagagcgacattttccagaaagccgtttaaggtcggagcttcttccccctccgcataatccacagctttgctgatcaattcgtcaatattttcgattcttgcctctgcctcatccgttccctctgcttcgagttctctgacataaccggtcgtttcaataacttcctgcagcagatctgccacggaaagcagctttgcctttgctttcatagactggataaacaacacaaacggccggatctttgctgccgctttgcccagccccggtacctgttctgccacacagagcgcatcataaaaactgatctcctgctcctgggcatacaatgccactttgttgatcgatgcagcaccaattccacgttttgggatattgatgatacgccgcaccgccagatcatcctgcccattgtcgatggtctttaaatatgccagcagatccttcacttccttacgggcgtagaaatttacgcctccaaaaattttatatggaatatttgctgtaataaaacgttcctcaaagagacgggactgtgcattggtacgatagagaatggcacagtctttatactgatactctcctttgcgtacccgccgggcaatatcccttgccacaaaatccgcttcctctgccgccgtatccagctgctcaaaggtgatcttgtccccggctccattgtccgtccacagacgcttttcctttcgcccctgattgttggcaatcacagcattggctgcatccagaatattttgcgtgctccggtaattctgctccagtttgatcactgtggcatccggaaaatgatgttcaaaattcagaatattgtagatattcgctccccggaacttatagatagactgatcatcatcacctacaacacaaagattctggtattttaaagccagcagacggatcagttcaaactgtgcggtattggtatcctgatactcatccaccataatatagcggaaacgatcctgatacgaggcaagcacctctttgtccagtttgaacagttccacagttttcatgatcagatcatcaaaatccaatgcattattctgctttaacgcctgctgatattcccgataaacctgggcctgtttccgtttcacataatcgcctgccgcgcgcgtctcaaattcgatcggatcgatcagctcatcttttgcggaggaaatagcagaaagaaacattttctctttgtacattttcgtatcgatttccagacgtttgcagatatccttcatcagagtcttctgatcatcggaatcgtagatggtaaaattggtgccaaaccccagcctgtcaatatatctgcgcaaaatacgcacacaggtggaatggaatgtgcacacccagatactttccgaaccatatcccaccatctggtcaatacgctcccgcatctcccctgccgctttattggtaaacgtgattgccatgatattgtagggattaaccccgcattcctcaatcagatatgccgtacgatgtgtcagtactctggtttttccggacccggcacctgccagaatcagaagcggtccgtcggttgccatcacagcctgccgctgtggttcgttcagtgcatctaataagctcatatcgtttctccgtctctttccataattcattattcgtgtgtctcattatatcatagatagtccgaatagaacatacattcttttgttttttgaaaaaagcatgaaaatgccttgtcatctagtttttattactatataatgtgatatgaggtgaaaatatggacaacgaagtaaaagaatttcttgctgcactgcagaagaaactggtttcaatcgattacatcaaaacggaagacattccaaatatcggtttatatatggatcaggtcacgacctttatggacgagcagttagaagcctgcaaacgctatgaagatgataaaattctgaccaaaacaatgatcaacaattatgccaaaaacaatctgctccctgccccggataagaaaaaatattccaaggagcatgtgctgaccctgttattcatttactattttaagaatctgctcagcatcaacgacatccagtccctgttaaatcccctgacggaacattattttggcaacaaagccggatttaatatggaagatgtctataacgaggtttttaatttagagagcaccgagtccgagaaattattaaaagatctcggaaaaaaatatgctctctcccgtgagacgttccggaaatttccggaaaatgatcaggaatttctgcagaatttcagttttatctgtctgctcagctacgacgtatacatcaaaaagatgattatcgaaagtgttatcgacaatatcaacagtcaaaacagtaaaacaaataaaaaagagaattccaaaaaggaatcctccaaaaaagacaccgtttaatccaaacggatgattgtattttcgggcacagatgcagatacgcatccgtgccttttttctattcctgttccggatgtttctgtgacagacggctgaataccatctcatatccgtcatttccatagttcagagaacgattgacacggctgatcgtcgctgtagacgcccccgtcttttccgcaatatcaaggtatgtcttctgatcccgcagcattcccgccacttcaaatcgctgtgataaagaaagcaattcattgaccgtacacacatcctcaaaaaatgtataacattcctctctgttctgcagacataaaattgcatcaaacagatgatctactgcctctgttttaagtttcttgctcattatgctccctctttccttccaaaaatcatgtctgtattttatcatattaaagttttaaagtaaacagatttcttgcattaccccattgttatgctataatgtttagtacagtttaccaaacacgaaaacgaatggagaatctatgatatgaaaaagatcggttattttttttccggctttctgccaattttaacaacaacagctgcacagatactggcttctttttttatgttcggaatcgcagctctgtttctgtgtccggccttccagagcacaggctttgatgccgataccatcgaaacacttctgaccaatacggagtttaatgcatgcatcatgctgatttataccgtaacctgcatcgtattcatgggaatatggtattatcgctcctgtgggggcaattatcttccaaaaccatccctcacgtttcatcctctgcagtttttatccatcattcttctgattcccggcatgcagttcttttccggttatctgacttctgcggtatctcttcttttcccgaactggctcagccagtacgaaaaactcatggaaaccgcaggcttagactccgacatcggactgttcatgtttatctatgccgtaattctcggtcctgtctgcgaagaactggttttccgcggcgtcaccatgcgtctggtccgacgggcacttccgttctgggctgccaacctgatgcaggcggttctcttcggaatctttcacatgaactggattcagggaatttatgcatttgttctcggtcttgtactgggatggatctgtgaaaaaggaggaagcatctatttctcaatgttcttccacatcctgttcaacttctggggaaccatcatcggaccgctattgaacaatctcaaagaaacggaccttctgggaattatcatctttctctttacaattgtttctctcgtttttggcttttccttattccgcctgggcacgaaatggcgcgatcagaaagcggcgcgccttatggctgcccctgatcatgatgatcatttcgaagcagctgaatgatccggtactcataaaacacggtgatcacaaggatggcggcaatcaccagcagactgtacgcgtccttgagttcgatcccgatcacatctcccacacacggaaccatcagaccgatgataaacaccagttttaccagccggatcatccggacggaatatttacgcacctttcccacacacacctctttcggaagccggtttattttttccggctgacagcttaccaggctgagtcccacatagatcagaacaactcctgcaatgttacagataaatttatatggcgcaactttataggcaatcccataatagatctgcagtccgatatagacaattccaaggatcattcctaccgcctccgcaaaaattgccggaacggttaaatcttcttttttcatctgcttttctccatttcattctgtaaaatcatatcctaattctaacacctttttgacttgaattccatagttcatgtgctataatgaaacacagagtaacaatataacaaaggagatctcatggaaaatcttattttaccaaaacaatacaaatcagaactgaatcttcatgacacacagcttgccatcaagacagtcaaagatttctttcaggcactgctggcgcagagactgcatctgacacgtgtttctgctcctctttttgtagacccggcaaccggtcttaatgataacttaaacggttatgaacgcccggttactttcggtattaaggagcaggacgataaaaatgccgaagttgtccattctctcgcaaaatggaaacgttacgccctgaaaaaatacggatttcaggtcggagaaggcatctacactgatatgaatgccatccgccgcgatgaaagtacggacaacattcattctattttcgtagatcagtgggactgggaaaaaatcattcataaagaagaccgtaatctggactatttaaaagagaccgttcgtaccgtatataagtgtcttcgcaaaacagaacagtatatggccatccagtatgattacattgatctgatccttccaaaggaaattttctttatcacctcccaggaactggaggatctgttcccggacaacacaccgaaggaacgtgagtattatattaccaaggcaaaaggtgctgtatgtatcatgcagatcggtgacaccttagagtccggcgaaccgcacgacggacgtgctccggattacgatgactgggctttaaatgcagatattcttgtttattatccggttcttgatattgcactggaattatcttcgatgggtatccgtgtagacaaaactgcactgatttcccagcttgacaaagccggctgtccggaacgcaaggatctgccattccagaaatccatcatcgatggaacacttccttataccatcggcggaggaattggtcagtcccgtatctgtatgttcttccttcgcaaagctcatatcggcgaagtgcagagttctctctggccggaagaaacaattgcagcctgcgaggaacatggtattcagctcttataatttattttacataataaaataaacaaagcaaaaaatcaaagaggaaaaacgaaaaaaacgtttttcctctttttgtattatctcctctaaattacagctataaggtttcctcatccgcctcgcacatacgataccctacgcccagttcatttacaatataatttttttctcccggtctggctcccagcttcttacggatatttaccatattgacctgcagttttttgatgctgccctcatcgttatacccccagatctctttgataatggctgagtatgtcataacctttcccgcatgttccgacaatgctgcaatgatattgtactctgtctgtgtcagcttcacttcttttttatgcaagaaaactcttcttgcatcgtaatcaatggtaagaccggatgcctcaaattttccccccggaaacattccgttttgcatgcgatgtgttgtcatgcgaagcgtagaacgtatccgcgcaagaaattcattggagccaaatggttttgtaacataatcattggctcccatatccaaagcctccactttatctttttcatctgacctggcagaaagcacaatcaccggcgtcagggaatctttccgtaaccgctttaaaaaagtcattccgtcctgatccggaagtcccagatctaaaacaacgagatccggtctgtgtgaagcatacatcatcattccgtcttcgcaggaatatgccgataatgcctgatatccgtttgcctccagaagtgtagccaccagattgttaatatgttcatcatcctcaataattaaaatcttatatttatttccgttcatgcctgttccttctcctccatatccagataaaaccggaaaagtgcacctccatttttcttattttctgccttgatctttccaccgtgcgctttgataattgttgcgcacactgccagtcctattcctgcattgctccgtttgcaatcggaagatacctcatatgcctcatgactcccgtaaaaaacggattttaatttttcttccggaattccacatccatcatcctgtacttcaaatacggctttgtccgccacaagaaataccttcagtcccaggtgcaccattccctttgcatgctgcaccgcgttttctaaaatattgatcaacacctgctggatcaggattgcatccatgggaattaccacaaattcatccggaatatcaatttcaacctcctgatccggatatcttttatgaaactttaaaatcaccgaatcaatcagctcatccaaaaccgtaggtgtcttaatgatttttacttttccactgtcaagttttgtgatcgaaagcaggttctcaaccatccggaaaagccactgtgcatcctgctggatgtcctgcagcatctttgtccgctgttccttcgtaaaatcattatccggatcaagcagcgccgagctggagccatagatcgtggtaagcggagtccgaagatcatgggaaaccgcacggaatatgtctgcacggattttttctttttctctctcttcttcgagaattttattatactttattttggtggtaaacccacaggtaatcaaagccatcagtataatgatcactgccgatgccatattctccggtatggaaaaattaaagtgaaaaaatggaaatgtgaaagcaaaattcaattcaagaacgctgagaattgcagctgccacaccatacagataccccggtgtgatcacagaagtcagaaagactccaaaaatagatactgccgggatcagcgcattttccacagtactgttttgtatccacaaacagaccataaaacacaccagctgaatcccgacggtaatggctatatctcttatgatatacaatgtttttttcatccgaatcttctttctccttatctcttgcatccgtatgtttcattatagcataatggcggttaagattcgaataaaaaatgtatttttctaagaaatcgtattcagttcctccatccacaatgttgcacacgcatcactcggcatacgcagatctcctctcggagaaacagcaacagatccgactttcgggccgtccggaaggcaggaacgtttaaactgctgcgcaaaaaatctgcggcagaacgttttcagccattttaaaataaatgcatcttcataagttcccgcaaatgcaatttttgccagacgataaatttttgcaggggaaaatccctgacgcaacatataatacaggaagaaatcatgcagttcatacggacctaccagatcctcggtcttctgtgaaatttttccgtcttccggcggcagaagctccggagaaacaggtgtatccaatacatcatacagtgtatcggaaagctgcttgtcctcacaggtatccgcataataacgcaccagatgccggaccagcgtctttggcacagaagcattcacggcatacatggacatatgatctccgttgtacgttgcccaccccagtgcaagttccgacagatctccggttccgatcacaagcgcattctttttgttcgcaatgtccatcagaatctgcgtgcgttcccgcgcctgggaattttcatatgtcacatcatgcaccgaagggtcctgtccgatatccgaaaaatgcacatttaccgactgacagatatccacttccacaaattctgccccaaggctttgaatcagtttgacagcattgtcatatgtgcggtcggttgtcccgaatcccggcatggtgacggccgtaattcccttatgatcccgcccgcacagatcaaaggcacgcacggtcaccagcagtgccagcgtcgaatccagtcctccggaaatacctaccacagcattggctccggtatgttccagacgtttttttagtcccattgcctgaatcatcagaatttcatcacaacgcttttccctgttctgtctgtctgttggcacaaacggtgccggatcaataaaccgcgtcagttttgtttcttctatttttaaagagaacagaatctcggtatgtgtctgatcctcagtgacaaaagttgtcattctgcggcgctgtgcacagagacgttccacatcaatctccgaatacaggatgccatgtccaaaacgcttggattccgcaagaatctgtccgttttccgcaatgatgttgtgcccggagaacaccagatcctgtgtagactctccctctcccgctgacgcataaatatatgccgcaagaagacgtgcagactggccacttaccagttccctgcggtaactgtctttgccggtcagttcattcgaagccgacaaattcaccagaacagacgcccccgccagtgcatgggagatactcggcggattcggtgtccacagatcctcacacagttccacaccgattctgagtttcggcatctgctcacagacaaaaagcagatcccggtccgcaggaacacagcttccgtccggcagaaccacctctgtcgcaagctctgctccggatacgaaatgtctcgcctcataaaattcattgtaattcggcagataactcttcggtacaagtccaagcacttctccatgggaaaacactgccgccacattgtataattttccaaggatttcaaagggaagtcccacgaaaaaaatggcgtccagtgaagcactctcttttactaatttcatcagcgcatcctttgcgccctgcagcagacgttcctgcaaaaacagatcctgacaggtatagccggtcagacaaagttccggaaaaactacaatctttgctccctgccgggtactttctttcatcatatccagaatcagttctgcattgtattttgtatctgccactttaattttcggtgtgactgcagctgcttttacaaatccctgtctcactttctcaactcctttaattcctctacggaaaattcatatgccttattacagaactgacactttacctcgatgctctccccatcattgatgatgtcatcgagatcttttttgctgagcgtcgaaagtgcgcgggatacccgctccttggaacagtcacagacaaatgctgccggaattttgtcggtgatttccaagccgaaatctccgagaatttcttcgagaattccttccggtgtcagtcctcgctccagcatcatagtcacagaatcgatctctgcaatacgcttttccagtttttcaatgatctcgtcactcgtaaacggcataagctgaataataaatccgccggcctgacgcaccgtgttgtttttgttcatcaacacgcccaatcctaccgcagacggaatctgctcggaagttgcaaaataataggttaaatcttctgcaatctctcctgtctgcagctgacactgtcccacatatggctcttttagtcccatatctttgatgacgctcaaaatgccgagatccagcgcgccccctacatttaaatgtccgtctttgtttggcggaagttccacaatcggattattgacaaatcccttgacatgtccattggcgtccgcagtaacggtaagtcccctggccggaccgctgcactgaatctgcagggtcagaagatccttttccccttttaacattgttcccatcatcgcaccgccggacaacaaacgtcccagggctgccgtcatgatcggggacgtattgtgatcctgtctggcggtctccaccagatccctcgatgtaattgcaaatgcccggattgcggcacctgctgcggttgctctaacaatataatctgccatgtatcatttctcctttattcttttcttgtaacaaatgtgatacgctcactgtcggctttgaccccggcgtcggtgtaatcatcatacattccttcacagaccagtcccgccttctgcagaaaatccactatctgttccaccttataatttctctgatagtgtgtttccgcatatcgacggtacagctctcccgcttccgggataaacagtgtcaggtcatattcattgattctggtctctttgtcataataattttcccagataaaacttccttcctgcctgctctccgcaaatgtgtgatctccaagaagctgttcgtatttataggcggtattcatatcaaagataaatactccaccgctttccagacaggcggcaacccgccggaatgcatcggaaagttcctgtggctcaagcacataattgacacagtcacaggtacagcagactgcccgcacacatccatccagttcgagtgtctgcatctcctgcagcagataaagaatcggcggatctgtctgcttttccatggctttctgcagcatatccacagaaacatccacaccggtcatatcatacccacaggcagccagtctccgggtcagttctccggtcccgcatcccagatccagcaccggtccgtctgcaattccatgcttttttaatgtctcacaaatatatgcacaccattcatcatagggcacattatccataaacaggtcataaacctgcgcaaaacccgtatacgcgtccattcttttcctcctgctttgtatcatagtttagcaagtttttatggcaaaagcaaggttgattattcttcccgaaacctttatactgaatgcataagttgaactacagaaaggattttccatgcctgacaactacgaacattatatttccaaaaatattcaggccttctatcgcagaagacttttttctccaatgatatatctggttttacttgcagttctctggatcgtatttccactgggtgccatgctgcgccctgcacagctttccgacaataccaaaattgcggacgcctacaagaaccatcaccgttatgtgcgcatgaccttcacagatctgaaattcagcggatatacctgtgaaacctatggacagacccgcggatattattattacaccacacagaaaaataattgcagcatcattctccttaccccgcatacatgtgaggaaggactccctacgatcgaccgtctgtccgtcaccggccggatcgtcaaaggaaaagaatcttatctggcacttttgtcccagctttcctctgacctgaactggaccgaaaccggtatccgcaatcagctgtcttcgtattatttcagtgagcctgactatcatttaaccacgacgcgcattttattcttcgcgtatttcggttccatgatttataccgtcctgtatcttctgatctgtatggtctatatccggttcccggtgctttccccaccgtgccagaacttgatcgtcttcggacatccgggtcagattctcgccgaggccgaggaagaacttgcaacacttccacagctggcaacggaggatatgtttattaccgaacattattttatcatgacatcaccatatggaaatgccattgtacctattcaggagattctgtggatctataaacattcgacgctccacaaaatgctctggtatcatttcagcatctcttataccatgcatattaccgcaaacaaacatatgtatgtaaactgtccgaaaaataccaaatccgatattgacggtattatggattacctggcagaagccaatcacaacattctggtaggtttcaatgaagaaaaccgcctgaaagtccaggcggttcagggaaaacctttccatattgaaaaattttatgcgttattgcgccgccgcgtctaaaacatacaggctttgcttccgatttcataatccagattttcataggcttcccttaccacgggaagcctttctttttcttccggcggtaattcatgttcagaaagtatctttatattctcctcaatctgtgcaatatcataggtatcaaatccatactttaaccttttccagcacagccggcgctgctctccatccatcatgggaaacttttcctgccgaagtatgtgaccgctttcctgtgaatcttttgtctcctgttttacttctttcaccgtcccctgcagctgctctaaaaaagtatgcagattccggtttataaaggcacgattttcggtctttgccgccatctccataatttctgcctgctgggcaatctcctcttttccaatctggcggctgatccctttgattccatgaacttttgtctgaaacatatgcagatcccgctggacatattccggaagtttcggaagtaaaccctccacctctttccaataagattccagcgtacggatatccgtagcgttcctctgccctgtggctttcgccttctttgacgcatcgaccggattcggaagttccctgtatctgaccggaattccggtttctaaaacctgcctcatccgctgcagccggatcggtttcggcataaaatcggtaaatccatgccggatggaacggcttctcacttcgtcagaaatatccgctgtcataagaacaagcggtgcatgactgtatctttgtatctgatccgccgtctcaaatccggacattcccggcatcatctgatccagaatgatcatctggtattcccgttcttttaccatctgtacagcttcttctcctgacaccgccagatccagtataaacttccatggagccgcaagttcctgaaaaatcaccctgtttgcttccatatcatccaccagaaggacacgtgcccgcggataaatccagttcggctgtatttcttcgacctgcggatcattctgttcttttaatatttcccgtccgatgtttctcggctctgatatctcagccataacctgtttctgataaaacccaaaagatacgcgtgtcccttttcccggatcactctctgctcttacccagccatgcatcatttctacgagctgtctgacaattgacagacccaggccaaagccctctacccccatatcctcggaaaacgagacatattccgcaaatacctgtgcaagtttttcctttgtcattcccacaccggtatcttccacacagccgtcaaaccatacctgtccttcttccattttacagtggagtgacagcgtgatcgttccctgttccgtaaacttgcaggcattcgataaaatattctgaaaaatctgtgccacacgtaaatagtccccacttacctgctccggaaaccggtccagaaacctcacggtaaatacgatatctttttcccggatattcagcagacaaagacgggcctgttcctcgatcatttcataaaaattgtatgttttgtctttgagcgtcaacattcctgcttccagcttcgaatatgcaaggatcgtatccacctgttcaagcagattatttcccgcgacacggatatattcaagaatgtttttgctctcatccggaagattctgcctttttaaaatatccgaacctccgataatcgcatgcagcggactgcgcagatcatgactgaccgatgccagaaaacggctttttaaaaatgactgttcttctgctttctttttcagatcctccatcagaaccgtttccttcttttgctgtgtgatgtcgagcagggtaagaatatatcctctcaccacattttcactgcagaccggatgcaactgacacctgcgataactttctttccactgaaccacataatcctgatccgggtctttactccaacgcatcattttggtataaaaagggtactcctgcggatcgtccgtcagttcccccacaatttccggaaaccatcgtctggcactggcattggcatcccggtaacgcattctgttgtcaaacaaaaacgtaggaatatcactgatattataaaagttttcccggataatgttcgtcacattggataacctgcccgtcatcatcagataaaagacaatcagacaggaaatttcaaaagctcccggcaccagaaattcttccgctttcggcgtaaccgcgcgaaacaacattgcaactcccggaagtgccatgccaagatacaacatatcatttacatgtccctcccagacagaaacctcgcttttcactctcacataagtagccagccccagaagaattcccgtataacaaagcagcgcaatccgaaacgcatcctgatacgtctcgtgctgcgcagcacgtataatcaacatggaattaaacagcaccagactgcagaacaaaatcacttccgtcctgagtttcagctggaatttcataaaatcacccacataatgaatcataagatacagcatgtgaatggccagtaaatctgtcagtatacgaagtgtctttgcctctcccgtaacataataggtaatgcgataaaaactgttcaatgcaatcagccctaaaaccaacggcagcagccggtgttcccttgcgtgaaacccgctgctgacataactttgtaatacaaacagtgtaaaaaaaagacagatcagatggaaaaccagtcccatatccgttttacctccaaccactaaatatccgctctacttcggatttgatataaatggctttatatggccgcacaatatatcctgccgcatgcagtctccgacaggtcattaccgtatgcgcatcacacatggccgtgacaaacagaaccggtatcctgccccctgtgagcttgtttgctctcatggtagtctcgattccgttcatttccggcatatcaacatccataatgatcagatccggaaactcattgtgttccagataatgcaatgcctgttttccgcatttacagagaatgacggtatactcatcctcgagaattccacgcatggcatccagattagtcttcatatcatctacgatcatgattttttttctggcagtttcctgaaccatcttctttctttccggctcttccgaatctggagaaaccgtatcaagatattccggtggaagaatcgtaacatttaagtttttattttccatcagatccagtttggtcccatccggcatattcagaatcggtcgcagattatgcggtcctttgttttcatagatcaggcccttacgtccatccgacagatttacctccgtccctctcggaaacagcggaacccgctccataaacacttccacaacatttttgtcaaacatgatgccacaggctcccatgagatactctaccgcctcataaggggaatatggtttcttatacggacgtcttgatgtcagcgcatcatacacatccgccacatgtacaattcttacggagagtgactgttcatctcccatcagcccctgtgggtatccgcttccatctacattttcatgatgaagaagtaccgtctgcttgatatgcgccgaaatattccagcgcttcgaaagcagctggtacgaacgggtcgaatgggtcttcatcagctggtattcatctggtgtcagcctgcccggtttgtttagtatttcctttggaatggcaagctttcccagatcatgcaaaagagccgctgtaaccagataattcagatcgcgttcactcattcccatccccataccgatcacacagcagagcacagcaacattcaccgaatgtgcatatgtgtaatcatcgtatgagcgcagatccgtcatatccagacacacattttccctggacaaaagattctccacaatctgttgtgcaatctcggcacaacggtcaatatcattctcctgcacacatttaaacccttcctggcgcagtttttccggtattgttgcttcgatgtagatatctttcgactgttcatcctcgatatagataccgctaaatccgtattcgtttagtttattgatataggaagccgtcagttcacagccgcttcccaccatggtacgtcccatggaatcatataaatcatacgcaagacacattcccggtctggcatcttcaatggaaacaaaacgcataaagcctccaattataactacaacttaaatcataaccagataaattgctgcaagtgaaattacaatctgaatgatggcaaagcgaaataccacctgggcattggaccacccacccttttttcttacatggtcgtggatcggtgtgatggtattctttagaatatgtatctttaaaaaccgaagcagtgaaacctttaccagaccaagaccaccgtctgcgataagtaccgcagcaaccagcaggtacataaacgggctgtgcatcttcaataccgcaatggcaataaaaatacccattgcacgtgatccggcatctcccataagaagcttgctcggtgttgcgttataccacagatatcccagcagacataccgcaaacagtaaaatacagtaattgaaagaatcattgacttttaaaatattgtcaagaacaaacacactcatcaacgtgataatggtcagtgttcccgacaatccatccacaccatccgaacagttggtaacattgatggaaacccacaccagaataacggtcagaatggcaaatacaaccggtggaatcacgatggtcgttcccgtaatggcaatggtgatctcactggaattgtaatgcagataggaaatggctacaacgactgccactgccagatccagaattccctttaaatactctccccatggtttttctgcggcatcatcaaagaatccggtgaacatttcgatgacgatcagcaccagataaatgataatttccttattcattttgccaaacaacaatgcggaaacaacaaaagtcaacacaaaaataatacccgcacctcttggttttcctgcggaaagagctccatcatgtgcatactgtcttcccatgtccttcggcagatacccgtttaattttgcaattgcaatacaggtcgctgcaaaagcaaataaaacaccgataaaagcaaccagtgcgtgttcatatgttcctaataagtatatcattttatcctccttcgggctttcacccaatttaattatattaggagacaggaaaaaagtaaagtttttgcttgcatttttatcgaattgtgttattatatactcacacgcgtcaaagcgttaaagtgtaaaagattcaaagaaccacaaggaggaaacaaaaatggctcaaaaaggagacttaatgacagcacgttccgatattcgtgtattggacgcaaccattcgtgacggaggactcgtaaacaactttatgttctccgatgactttatcaacgcactctaccgcaccaatgtaaaggccggcgttgactatatggagtttggttataaagcttccaaggagctgtttgacgtaaataaattcggcaagtggaagttctgtgatgaagaatccatccgtgagatcgttggtgacaacaactccgatatgaagatttccgtcatggcagatgtcggacgctgcgattacaaaaaagatatcattgacaaaaaagacagtgtaattgacatggttcgtgtggcaacttacgtgcaccagatgcctgctgcaatcgaaatgattgaagatgccaaggcaaagggctacgaggtaacctgtaatatcatggcaatctccaatgccaaagaatccgatattgaccaggcacttgaaatggtcggtcaaagcagcgccgatggcatttatatcgtggatagttacggtgctctttacccggaacagatccgtgcgattgcagataaatacaccgaacttggagaaaaatacggcaaatacatcggtatgcatgcacacaataaccagcagcttgcctttgccaacacgatcgaagcactctcccacggtgtcagtcttttagatgctaccatgatgtccatgggacggggtgccggaaactgtgccatggaactgcttctgagttttctgaaaaatccgaagtacaatgtattcccggtactccggttcttagaagactatatgctgccgctcaaagaaaccggtgccgtatggggatatgatattccgtatctgctgaccggacgtctgaaccagcatccatctgctgccattgatttttgcaaggacaaccgcaaggattacgcagatttctataccgatctgttagacaaataaagcataatacaaaacaggcatccggggttcgccagatgcctgttttatttctgttataaacgtttaaatctgtctgcaaagtgcatccactttcgcaatttcttccatcatacacatttctttcagatcctgtgcatttccttcggaatgttccacttcctttgagaaaatacgcgctacgtcaatacggtcagacattgtgaatttgccaccgtttctgtgaaaacgtgccgcatccatatctcttaccacaagggttgccatcacaatcattttggcataggataagatatcataatcatatatcgcattcatcagataacgatacacaaaataaaccagaagatgttcatagccaagttccgaataatccgatgatcgcatatattctgtcagaaatgcctcataggtatcttcgtgatacagcttttcgaattcttccttggtgtgaacccattcctcatccagctcttccatatcggcaaaaaccgcaaaacgttcctcgaaatcttcataagaaagtgcacgaaccggcttctcttttccctcaatatttttctgctcccactcccgaagttcatgaccggcatcttcgtatctccagtctgccagtaccgacatatcctcttttgcctgtgcataattgatcacggtctgtacacggtcacaccacgccagaaactctctcatgcgctccggaatattatgggtacgattctgcagaatattcaccgactcctgctgcacccattccatgaatgcaacatatgccggatcatcctcaccgtcatcgcaatttccgggcagctctatatccaccagcttttccggttctgtccgctcaaacagaatccgtccgacttcctcgcaggaaagactcagtgctttctgctccacatctccgtaaatcagggaaaaacgcggatattctgtacacacttcacacagagcctcttccccaagtgctgtataaagatcacagagattatggtcattgagcatggcacagcgtttcttccctttcagcttaaaacggtatccaccgccatcatcatccggatcggcctcatacatactttctttgagtcttttgccaaatttgccttccacactgttgtaatatgcataggaatcctcatcaatgtcaatttcccagcctgcacagcaactgtccttgcagcgggatgcaatgcaggaaaatttctcataatattccggaacccgtaaaatcacgatgcctgcctctctttctcttctttttctgccatgtactctttctccatagtttcccagtccggatcctgtgtgcctttaaagtgattataggctatatagccaatgcaccagatcaatcctgccatcgttgttgaaaaaagtattttgacaacacataccgcaagcagtgtgacattcaggtcccctgccagaaaagaaactgccagagtatgaagcggcagcacaagcatcttccacaacccgtaatatgctgctgcaatcacaccgattgtataacagacaaatcccaacaatgcattaatatgctttttcatatgtatccatcctcgttttcataactattccatcaacttaactattttgccactttccatggtttttttcaagtcaagaatgcgctgattgaccgatccccggaacttgagcgtaatatccttctgttcctcaataaatggaccgtccaccagtacatcgatcagggaaagcaggtcatccgtgtctttcgtatgttttctgcctcccaaaatcaggtctttatcatatatatatccggtaaatgcccagacattcttatccggatacaaactttttacttttttcataaaaggaagaagagcctcctgattttcttcctcaaacggctctcctcccaacagggtcattccctctatatactccggtttcagtgaatcaagcaccttttgctgtacctgctcatcgaaacattctccataggtaaaatcccatgtctgtggctgaaaacagcccttacatgcattgcggcatccggatacaaacagtaccgtccgacagccgagaccgtttgcgatgtcacaatacttaattccagcataattcataatttactctttctttttattcaggaaacggatgcagcctgctgctgccagtaaaaaaacaattactgctgctccaaataccatccgcagatcaaccgcacctgtctttggtgttgcatctgtccggtttccgttttttgatgtatttccactgttattctttttgttcgatgaagttttgtgtgtattcccgctgctgctctgggaatcctgcgtatcgtctgtatcatcgtacgaatcggtatcgtccgtatcgtctatatcatctgtatactctgtgtcatcctgactgtccgactgactctgggaagtgctctgggactgtgactggctctgtgtctgtcctgcagaagcatccacaaccgttgtaaccgtaaccggattgtaacttgcatccgtcacttcacgcactgtcagggtaactggcatcgttgtatatgcatttttcgccttaaaggtaaccgtggcaatggtttcattctgggaataagtcttatttaaaattgccgaaagattaagtgcctgctgattattttccgtaaccggggaaaccagctcaatatttcccgaatccgaagaaatcgtatttgcccatgtggttcctacatattccagatcagaatcgtcatatgccagtcttgctgcaaatgtcgaaagtcccggattattgcttccgaccagacgtaccgttaccgtatctccggcttttgcatcattggttgttccaaccgtcagattcatctggctgttcgccgccataaccggctgcggaacggctgcaaaaagcagcgccagcgcacatcccatcatcagtatcgttttcatcatccctaattttttcatcttctgccctatatcctttttgctatgactacgagtctcccattgtttaccgtgtattcacaggtagagagcatgattgtggtatctccatagataagatgctcccctgtatcatacacacggttctcttccacaaaatccagcagattctgaaactctttccggtttttataattccgaaaccagtaataacggaatccggattcgtctttttcctttacatgtgtctttaccaccgcaacaatctgatattgtccagtttcataaatcgtatcaaaagtaatcaccggatgctttttgtaaaatttcttatccagataggcatccagatctccaaactggcttccatcacttacgttgtgcccaaagatcacaatattctgatccatcggatcaatgctggcatctgcggaaacaaacgggtttcccttattatcatcttttccttcaaaattgtgtttcagataatattccccgcctgtatgatcctgcatcaccggataatcgattggtgtcccgtcaactttgatccatccaaccagatccggatacatactatataatatatcatattggtctaagattgcaagctggtccgtcttttctgtctcacaatttttcatttgctgcttttctttgcggatatattccaaaaccgcttccttttttgcctctttgatctgaaaataattcaatgcaagtaacagaacaaccgccatggccaggaaagaaaaggcgatgcgtctgcataccttttccaccatcggccgatggcggtttctgccactcggcccgatgggtttttctttctcttcccggggttgtggatcttctacctcatggtgttcatacaaatgggcatattgtttccgtttgttttcttccatgttttataaatgtaatactctttctttgatttcctgtgtacgtccctgattccagaactgtgttccgatatacccgcacgtacgacgtgcaacactcatcttatcctgatcacggtttccgcagttcggacactcccagacgagttttccgctgtccttttcctcaacaattttgatctcaccgtcatagccacattccatacagtaatcactcttcgtgttgagctccgcgtacataatattatcgtaaatgtatttcatgacggcaatcacggcatcaatattatcctgcatatttggtacttccacatagctgattgcaccacccggagacagcttctggaactgtgactcaaacttcagtttatcaaaagcattgatattttccgtcacatgcacatgataactgttcgtaatataatttttatctgttacgccctctatgataccgaaacgcttctgcagacactttgcaaatttataggtggtggattccagcggcgtaccgtacagactgaaatccatattttccttttctttccactctgcacaggcatcattcagacgctgcatgacacgcagtgcaaatggtgttccggtctccggctccgtatgggaaacacctgtcatataacgggtacactcgcacaatcccgcatatcccaaagagatggtggaataaccgccaaataaaagtttgtcgatcgtctctccctttttcagacgggcaagcgctccgttctgccacagaatcggagccacatcactcggtgtgccaagaagtctcttatgtctgcacatcagtgcccggtagcacaattccagacgttcatcgagaatcttccagaattttttctcatcttttccggaagaacatgccacatccaccagattgatcgtcacaactccctggttaaaacgtccataatatttcggtttttcggtttccgggtcaatatacggagtaagaaaactgcggcatcccatacatggatagcagtgtccttccccgttcttgtccactttcagttctttcatcttcttttcggaaatataatccggaaccatgcgctttgccgtacactgtgcagccaggcgtgtcagataaaaatacttggaatcctcatggatattatcttcttcgagtacataaatcagtttcgggaaagccggggtaataaatactcctttttcgttctttactcccttgattctctgatgcagcatctcctcaatgatcgctgccaggtcatctctggtctgtccctccggcacttcgtcgagatacataaacaccgtgataaacggagcctgaccgtttgtggtcataagcgtgatcacctgatactggatcatctgcacaccacggttgatctcttctcttacacgcatctctgctactttattgattttctcctcatccagatccagcccgatcttttcaaactctgtccggacctgtatccggaatttttcacggctcacctgtacgaacggtgccagatgggacagtgaaatactctgtcctccatactgcgaacttgcaatctgcgcaatcgcctgtgttgctatattgcaggccgtggaaaaacttctcggacggtcaattccggtctcgctgattacagtaccattctgcagcatgtcctctaagttcaccagacagcagttatgcatgtgctgcgcaaaataatctgcatcatggaaatgaatcagtcctttttcatgtgcttccacaatatcttctggcaacaggaatctcttcgtgatatccttgctgacttctcccgccatataatctctctgtacactgtttacagtaggatttttattggaattttcctgttttacttcctcattgttacactctaagagggacagaatctgttcatcagtagaattggatttacgcacaagtgctctcttataacggtatgtaatataattacgggcaaccgtaaatgcatgctggttcatcagctggttctctaccatatcctggatttcctccacgctggcagaccgtttcatgttttcacatgccacttccacattatcggcaatctcctgaatctgctcatcgctgagtttttcataatcgattaccgatgcattcgctttctgtacagccgcaacgatcttattcgaatcaaaaaatacctcgactccgcttctcttaataattttcatgttccatcttcctctcaaagtctatctttataaacgattgtttacacaaaatataagatatagagattactccctatatcttgtatattttcattaacaaatacaagactacactacatcttgtgttattgtcaacccacatttctacatcatgtggaggcttactccatggaaatgtagacgtatctaggcgtttatgcaatatgtgaaaaaattccgcgccatttttgtaataatttttacagtctgctgtccgtgcgcagcacatcaatgaatttgccggcttctgcccatgccttctttgattctggaatattcagatatgccatctggaacacatgaaacatcccttcataaacagacaggcgcacttttaccccctgctcccttgcctttgccgctaccgaaaccgaatcactcagaagcatctcaatcgatccaacctgtatgagcattggcggaaatccccggaaatctccaaacagcggagaaatatacgggtccatccggtcatgttcccccggataatcattctggtaaatcagactctccttcgtatttccaaacagtggatctttctcataattggtctcataagactccccgctggccgtcagatccgtccacggagacatggctatgattcctcccggtaccggcatattatgatcccgcagatacatacagagtgccatcgtcagtccaccgcctgccgaatctccggcaaggataatctgttctccataatatcccttggaaagcagccagcggtatgatgccaatgcatcttcaagtgctgccggatatggattctccggggccacacgataatccggagtaagcacattgcatccatggctcagctcgttatataatcctgcaaacacataatacgcattgcgcacagctcccgtataaccaccaccgtgtaactgcagaatcacgtaatccgtgtttggattttcctttaacgacaaaagtttcatcgtaaaatgatccatattgattcctgtcaggttaaacattgccggtggaatccatggcggctctatcatccgcttgcgcagctctccgctctttattttttttccgattttcaaatcattggtaaaatgtgacagcatttctgccaccacacgtccttttacactcgcttcgctttctatcatatatgaaatctccgtttcagttcggttcgtgcacgctgatcaccaagaatcagtgttccaaggaataaaaataccgataccccgagggacccccatgccagatatggaaaatgaatgattctcatctgcagcaataccaccggtacaatgctcagcaatatcgtcagcagttccgacatcatataactctgccagtttctccggtttaccagaatcaggataaacaacgccagatcaatggcaatgattccccccggaaacacatagtctaacgaccagcgccggtatccggtcagataatcaattccaagaagcattacaatggcaagaagtaccagacagacggttttggccagatatccggattttcccagaattgccatgcgaagcaccacatttccatataaaagaatgataccaattacaaggctccatgccacttccctgtccacctgaaaattgatggcaatcagcagacactccgccacaatggagataaacagtaccagattctccataaaccggaatttacgcgccgttgcaatggcatccggataccggctctctcccggtatcccgtccgactccagcacatgtttacagagcggacagcggtccgtatcgtccaatatgacaacattacattttttgcatttattcataatatactccgttcgtctcaatctccacatccacaccatccgccgcaatcttgcggaaaaatgccttctgtaccagagcctcggaaaagatggaactgaatgtaaataccagcgtatcctggtaagaacagatcgttcctttcagatactgcccttttgacatggctataaaagccgaaaaaccttctatatagggctggtaaatatctttgatcttgatattaccgatgtttgtgatcgttgtcgtatttgccactgcggatttttcatatacgatacgcatggcaatatttttcaaaaataacggcaccggacgcataagcaggttcctctgattggatacactgtaagaaaacagatcctctaaatgttccttattgatctgggagtgcaggctgctttgtatgcatgcaagtacttcctcaaacgtataggactctttctgtggacggaattctgcagataccataacaaaaaagttttttgtcgtatccgaatcaaaatacggccgcagattgaccggcactgcgattcggatcggttttcctcccggcatcccgtgtaacagttctttatacacactccatacaaagactgcaacaaaatattcattcaaagatgcatgatagccatgtgctacctttttcagctgtgagaccggcatccgcccatgcatgacaccaaattctccggccggaagtttatcttctttgatcagatatgctttttctttattaaatccgcttggcttgctgctgcggtaattgcggacaaagctgtcctccctgctgagagaggtatctccgctcagtttgtttccttctttttccgccagttccggatgcaccagacgcagatactgatacgtcagctcccggaggaaattaatgcctcccatgccatcggtcagtacatgaaacacttccagattgattcttgacttataataggtcacacggaacagataattgcggtttttgttctgccggataaaccggcatggaaacatcgcctcttccgtgactttcggcgccttttttccgttctcttcaaaataataccagaatacgcctgtgcgcatccgaagattaaaaccatcgaatttcggcagaatcatgtccagcgcctgctgcagaaattccacctgaacctcttcttttaaggtcacactgatccggtacacgtttgtcatactctcccccgcaatggacgggaaaagatgtgctgtattatcaagcttatcccagcgcacctgacgcggaatcgtcttggtttttttcttgtctttcattgattaattacttccttggttatttcaaaaacatgccgaatcctgccacactgagcaccatcataataattcctgccagcagaaccccgagcatgacggcgataattgttgatttaaaatccatgtccagaatactggccgccagtgttcctgtccatgcaccggttcccggaagcggaattcctacaaacaggagcagtgcgataaacagcccccggcctgctttttcctgtaatttctttccgcccttttctcccttctccagacaccaggaaaaaaactttccaatcaccggtttatccgctccccataccagaactttccgtgcaaacagataaatcaccggcaccggcagcatatttccgataattgccacaatataagaagaaagtaccggcagctgcagtccctgcgaaataataatggaaccgcgcagttccaccagtggtaccatggaaacaaaaaatacccacaagtattttgtcaacataaaaaatcctcgctttatttatttaaatattttttcagaaaatcgatcagtttatgcatctgctcatccgtaccgattgtgatacgcagatattcgttgatccgtgccggcttgccaaaatgccgcacataaatatcgtttttcttcagtgcttcaaacagttccacaccggaaacatccggatgcatggcaaaaataaagttgcttttggaatcaccaaatacgaacccgagtgcccgaagctgctctttggtccactctcttgtctttatgattttctctgtcgtctgctcaaaatatgcccggtcacggatagatgccgttcccaacgcaatggtgatacgatccatcgtgtatgaattgaaggaatacttcacatcatttaaatatttaatcagtgtcggattactgatggcaaagccaatcctcgaccccgccagagaacgtgacttggaaaatgtctgtaccacaattacattatcgtatttatcaatcaaaggcagggcactctctcctccaaagtcaatatatgcctcatccacgatcacaatcacatccggatttgcctgaacgatctcctcaatggcagataccggaagaagttccccggtcggtgcattcgggtttgggaatacgattccaccattttcccatttataatctgccggattcaggcggaatgcatcatccagcggaatctgtgtatacggaatgcgaagcatttctgcccacacgtcataaaaggaataggtaatatccggaaacagaatcggcttctttgaattaaagaaggtcataaacagcattgcaagcacatcatccgatccgacaccgacaaagacctgtgaaggatctacctgatagaattgtgcaatcccatccaccagatctgtcacaaccggatccggatacagccgcagatcatccgtatgaaaatgtgccagtgcttcctttacccccggtgccggcggatatggattttcattggtatttaacttgatgatctgtgatttctttggctgctctcccggtgtatagggaacaaccttacgtatatttttttcccagtttttcaactttaatctcctttatatgtacaatattacagtcacttaccactctaccgcattcttcctcaaatgtaaagaattgacgcggcaaaaaaaacgcaaaaaaaatgaaatttcagcattttttcctcttgtagttttacacaatcgtgataaaatatcctagcatttgcagttttgtttaaaatataaaaggagtaaatcattatggcaagaagtacaacaaaagaattgaccagcggttcccctatgaaactgattctcggtttcgccgtaccgcttctgttcggtatgctgtttcaacagttttacagtctcatggacaccatcatcgtcggccgctatctcggcgtaacggcacttgctgcagttggggcaaccggaagtatcaattttctgatcataggattctgtcagggaatctgcaacggtttcggtctgccggttgcccagcggttcggtgcgcgcgactatgacggtgtgcgcaaatatgtcggtaattccgccattctgtcggttctcatcggcggtgttctcacggcactgaccgtcattttctgtcggcagattctggtgctgatgcagacaccttccgatattatcgacctgtcctacaattatattgttgttatttttgccggcataccagccaccatcctttataatatactctcctcctacctgcgttctctgggggactccatcacgccggtcatttttctgatcgttgcggctgtcttaaatatcggactggatctgttctttatcatctgtctgcactggggagtttttggtgccgcatttgctaccgttttatcgcaggcggtttccggtgtgctgtgtcttttcgtgatcatccggaaatttgacattctgcacctgaagcgctccgactgggtactggatgcttcctatgtaagaaatcttctgattatgggacttcctatgggtctgcagtattccattaccgccatcggaagcgtcattctgcagactgctgtcaacaccttaggttcaggcgccgtggcagccatgacggccggcagccgtatttcgatgtttatggtgtgcccatttgacgcactcggttctacgatggcaacttacggtggacaaaacgtgggtgccggaaaatatgatcgtctggcaagcggtatgaaatccgccatcattcttgccgcaatatactccgcagcaatccttgttgtcatcattttccttgcatgtccactgatctatctgtttattgatccttcggacagtgccaatatcacacaggttgtcgcacaggccagacaatttctgatcaccaacacctgcttttatatgcttctgtcgctggtcaatattgttcgttttcttatccagggaatgggattttccggctttgctgtatttgccggtgtatttgagatgattgcccgcgcattgatcggtctgatctttgtgccggtcttcggatttacggctgcatgttttgccagtccgctggcatggctgtttgcggattgtttcctgcttccggcgttctttcattgccggaagaaacttatgcgggggcttgccaataaataacaggtataaatataagttttctcgatgcgacgggatctattgataaaaaaatagtgattaaggtgacacatttccttattttcaatgcctaaaataaaggaatgtcacctgcaagagaaaaattgcttcttcagataccgattttttgaaaaaatggtacctaaagaagcaatttttgttccatagagactttgtggtatctaaatgttacattttaagtgtatagataccataacggtatcttttatgcaaattttctttgtatagataccagcacattttccaaattatcttttctccaaccaacaggaagaaggcgtatatttctttcggaagaacaaatttgcaacttgctctggcactcactgaataaagataattgcataaaatgaaaatccttacacaaagaacctgaaatcaatgccagagctgctttgcaaatttttctgtagaaagagaatatacgctttcttccgtcacattgagaaaacttatatctgccagagaacgcaattaaacagctgcaataaaacgttcgaatgccttacgtccctccggtgtacatttatacacgccggcatcctgcagcacttcattgaacaccagaccgatttcctcatgcagaatatccatcacattgtcttttgtgatcttatcatacttcggaaggaaaccttctgcccattctgcatgggaagcaagtgtttctgttgcacgtaagtctgtaccatttaccagtgcatcggcaagctctgccatctcatctttcaggcgggcaggcagtaccgcaagtcccataacctcgatgagaccgatgttctcttttttgatatgatgcaggtttgcatgtggatgatagacacccagcggatgctcctcggtcgtgatgttgttgcgcagtaccagatccagttcaaaatcatctccacgtctgcgtgcaatcggtgtgatcgtattgtgtggctctccgtttgtctcggcatagatgaatgcatcctcatcggtatagcctctccaggttaagagaatcttgtctgccagttcaatcagacgctccttgtccggtccgctgatacggatgacagacatcggccatttcacgattcctgctttcacatcggaaaatccctcaaactgaagttctttttcaatcggtgcttttgccatggcaaatgtataatgtccaccctggaaatgatcatgacttaagatggaacctccaacgatcggcaggtctgcattggaacccacaaaataatgtggaaactgtgtcacaaaatccagaagttttccaaacgttgcacgctcgattttcattggcgtatgcttggaattgaacacgatgcagtgctcattgtaatatacatatggagaatactggaaaaaccagtcactgttgttaatcgtcagtggaatgatgcggtggttctggcgtgccggatggttgacacgtcctgcatatccctcattttccttacagagctggcacttcggatacgcgctctgctttgcattttttgctgccgcaatggcttttggatctttctccggtttggacagattgatggtgatatccagtgttccaaactcggtgtcggttgtccacttgcggtcttttttgatacgctgtcttctgatataattgctgtcacagcttaatttgtaaaaataatccgttgcggcaagcggtgaggtatgctcatacagatcacggaacgtcttgcggacactgcttggttccggtaccagacatcccataatttttgtatcaaacaaatctttgtatacaatactgttttctgccatgagaccattctcatatgcataatccatcatttctgcaaggattccctcaagttttccttctgcctcttcctgtgtccatgccggaagattttccaccttttcaaataccgcatcctcgatttcgtctacctgaaaaagctccagcaggcggttaatggtatatactttgtcctccggatctaccagtccggtgctcagaccatattttactaactctaaaatgttctcctgaatcatctcgtactcctttttataaagcctgtcggcaaatgcggttccaatcagttccgcacacatttaccctatgtaatacgttcttaaatcagacggcttgggccatctccgatggaaaccacataaaattccggtgtctttccgactttttcctcatatgcctttgtcagcttctccttgaattcgtccacggatgcatcctttacgatactgaccgtgcatccaccgaatccgcctccggtgatacgggaaccgatcacaccaggaatcttccatgcttcatccacaagtacatccacttccggacaggaggtctcataatcgtcacgcagggaaacatgggaagcattcataagttttccgaatgtttcaatatcgttttccttcagagccctgactgctgcgattgtacgctgattctcgtaaaccgcatgttttcctctctttctggcaacttcatccttaatggctcccttgtactgctcaaactgctcatccgtcagatctccaagcgttttgatatccacaacggtctgcagatccttcagtgcctgtgcactctcatttctgcggtcattgtatgcggaagtaaccaggctgtgttttaccatactgttggtgacgacaatttttgccccgtcaagtacgattggtgcatattcaaaagaaagatccgaagtatcaaggaaaattgcattgtcctttttacccatggcagatgcaaactgatccataattccacagttgcagccattgtaattgttctcggaatactgtccgatcagagccagatcctgattggtcacatcaaaaccatacagatcctttaacatatatccggtaaccacttctaaggatgcggaagaagaaagtccggaaccgtttggaatatttccgaataatgcaatatccagaccggtttccagtttcatgccacgtccttcaaatgcccacataacacccatcggatagttggtccacaatccatccggatccggagtaaatgcatccagagaactttcgatcacacccagctcatcgaagttcatggaataaaaacacagtttccggtcggttctctttcttgctgccatgtaggttccaatagtaagtgcacatggaaatacgtgtccgccattgtaatcggtatgctcaccgatcagattcacacgtcccggtgcaaaatatactctgatgtccccctcatcgccaaagatctctttaaactttgctaatacatcattctgaatcattgttctctccctttctgcatgttcatccgctgcttggtgcaacggttcgttttcttgataattccattatacataaaggggaattctttgcaatatgctttgcgcaacttgcaacattccccttccttcatgcaacatttttacatatcttattttctaaaatcacgaatcacttccagtgccggaaggacatttccatcgtagtcaaacaatgcctgatttgcccactcattgccacatggtcccggatcattcatatactttaaggatgccggcgttgcccagccgcttccgtgtaccggaatccatgcaggctcccaccagaaaaatcccagacctttgttgtcacgcacatgtgccacgcggtttaagaagtccttcgtaaaatctgcctgtccctgtaccgtcatcggatactcgatctttgccacaagttccggctttgtcgcatatccctttcgctcactgtcctttagtttctcatactgcttgtaatcttccatggtatatcccatagaaacctctgccacgatcagttccttcccgtaacgggctgccatatcgttcatgttgtcttcaagcatctgcagggtgccatgccagaacgggtaataggaaagtccgatataatcaaaatcttccccacgctccatataatgatcgaaccagtcgcggtacatctcattgtttccaccgttgtcgagatgaatcatcagcgggatctccggcttaacggcacggcatgcccggataccggaactgataaatcttgcaatattgtcataattcggctttaatccctccggccagagcagtccgttggtcacttcgttgcccacctggatcattgtcacattgacaccggcttccagtactttgcgcagagaatcctcggtaaactcataaactgcctgttccagctggtccgcatcaaaatctttccatgcctttggcttaatctgttttcccggatctgcccagaaatcactgtaatgaaaatttaataatatgccgaatcccgcatcagatactttctttccgatggcaattgtctctgccagatcattgcatccggcaccgtacggttcaccggtttcggaatacgggtcattccacagacgcagacggattgtgtccacatcataatctctcatgatgtctaaaatatcccgctcttttccatggtcataatattttgccccacagcgctctaactcaagcaatgtggaaaggtccattcctttaataaatctgctcatcttttctccttttcttcgaaaacgtttaccatccctttaatgcgttaatatgaaagttctgtaatttccgctcataccgctgtggattgatcttccactggtatggcgacgtattaaaaaattttttaaaattccggttaaaggtggaagttgtggaaaatcctgcctttctggcaacctcatccatcgaatcattgccatgcttcatctgttcacacgcgtattgtacacgcaccagattcacataatccatcggcagcatatgcacatattcttcaaacactttccggaaagatgtctcactcatcccacagacctgcgcaagggtgcacacttttacctcttcctgataatggtcattgacaaacgtgagtgcatctgcgatctgccgcattgttccgcttcctgccgcctcaagtctcgtctgtgtctgtacttcattcagacgaaacatctcatacaccagcgcatgcagataacttgtgatcacctgacgataatacggactctgctttttttcttcccggatgatggcgttgacgatctctgcaatctccggatactcgcttccatgcagcaaatgtgccgatctgcgtaccagttcaatggcctcatttttttgtgcgatccggtcgccatacagttcctccatgacatggttgacatccacatataaaaattcccaggaattccgaaccattccattactgatcgttgtatgtggaatattcggaggaatcagagtgacagaatttgtccggtaggtatacgtgtgttcatttataataagctccccttcgccttttctgcaaattccaatctccataaggttatggaaatgcagataaaaattgtcatgtccatatacccggttccactcctctcccaacaaagcaagtaccggttctccctgtggaatttcataaaaacgcagttccacggtttctttttgttttcgtcccataggcatattatactccctgaaagttataccctgatattaaaaacgtgcggcagctgccgcacgttctttttagtcgaaatcaaacttgtcgaatctcttatgcattgccccataacggaatcgaaccatctcatttttcgctaaaacgtcttcctccgtacctctgtactggcagcggatacaactgtaaatctttgtatctttattgtagaacatatcgatgtcgaggtctctcataaagcaggacggacatctgtaatttaatttgccttttccaagttgagccatgttgcaaatacctccttgtctgtaatagtcttcttatatccaagtttaaacattggtgagaatgcatatccttcctcaatgtatccttctgcgtctgtagaagaagcagtcagggaaactttggtgtcgattggaggcactacagcgctgactgcggttgctcctgccaggacttcactgcggcacttgtatgcatagtgaatggtcttttcatctgcaccttcgcattttaatacgacagatgtcatatcttccggatactctgtggttccgtagcatgctaccatgtactcatcaatggtaacctctgcatccggatcactcatctcgagaatatttctttcgatcttgatcttagaagaaccttcctcaaaatattcctttgtctgtaattttactgtcagtccgttaaactcgatggttaccgggtccagtgtcaggattctggtattgccttcctgtgagaaatgtgcatgtgtcgggcagaggcacagatctacttcctcacccttgtagcagagctttgcacttctgactgttccttctcctgcgtaatgtgtaaagtatccggcacggtacttctcctgaatcaggaatggataagaagcatcctgtacatgaggtgttccgataccaaccggccagtttaattttgcaacatatggacgaaggtcaacaatcgcaccaccctgatccatattaacacaggctctcataaacggatcgcagtaccagaacagctgcttgtcagatccgtataaaatatctctccaaagggcacattccggctctgtataacgtttctcgtcggtaatgcctttcttctttctgtagtgatctgcgaactcggacatggtcatatctaccagcttgccctctttcttcaaatctccgtaatacttacatccgtcactgtatgactttaacagcagatcatatggagcctcccagcggcccatcttgttcatccagcctggtccgacgaacatcatgttgtaagcatatccattgttgtatttttccagatcacgatactgatcgatcaggttatacagatacggatactcccaggtctttgtatcataaatcataccgcgaagcacgttctgtggatgtgtaccgaagtttgatccgtttccgtcataacatgcaatcaggtcacgggaaaggtgtgggatagctacgattccactgtcctctgcctgatttgctgccggcgcatgtgtattctgcttggatggaatccatggtgcccatgggccgccatcgaaaagtgtataccaggagttgttacaggtatgatatgctttcgggccttcctcccagcaggtagctaccgcacacttcacagacgggtaagcttccttcacataattgatcagttctgcgtccatatagtaggaaccggttgactccgggtaaaagccgaaacgatcatggaatttctcgaacacatcattaacgattgccttcttgtcttccatggaaaacatccaaatacagaaatcttttgtcttatatttctcacggaactcttcgcaaggcagtcccaaaagggaaagtgcgatttcgtctccatagacttcatgatcatgttttgcgatctcaaccgcttcatcgttaaacaaagaagcatatgtcatctgaatggtaactttcaggccattctcatgtgccagtctctgctgtgtcttgaaaatatcgagagactctgtaagtaaagccttatctccgatatcctcttcctttccctgtccggtcacggttgcagaatactctggaaccatctccgggcgatggatgatgtttacaataaatttgtccatctcgttctccctccgctagatgtattttatttctggactgcgcttttgcgcaatcggttgttctatgattctagtataacaagagagtcccacagtgtcaatgtacaattttgatatatttcgctttcttttttgcacacttttcacaattccaagcatattctttttcatttgcgcaatcggttgtttcgtgtaattttcaatatttttcgtattttttagtatatttttcatgcatatagaacccacattttgcgcaaattcatttatttttcatcatccaaacacaaaaacagccatttggatatttccaaatggctgtttttgtgtttggattttagagtttatgatcctacgaacagattccgcatgtccgtatcctgtccctttgaaattagtgatggaataaacggattccagtaaagctcataaccataccgtatttattacatgtctcgatcacattgtcatcacgtaccgatccgcccggctctgccacatactttacgccgcttttgtgtgcgcgctcaatattgtcgccaaatgggaagaatgcatccgatcccaatgccacatcggtatttttatccagccatgcacgcttctcttctgcggtaaataccgccggttttaccttaaaaatcttctcccatgcaccatctgcaaggacatccatataatcctcacccatgtacagatcaatggcattgtcacggtccgcacgcttgataccgtcaacaaactgcagtcctaaaacctgtggagactggcgcagccaccagttatctgccttcgaaccagccagacgggtacaatggatacgggactgctgtcctgctccgataccgattgcctgtccgcccttgacataacatacagagttagactgtgtatactttaaagtgatcatggaaattgccagatcaatctttgcctgctccggcagttctttgttttctgtcacgatgttgtcaaagaaatcatctccgatatgaagttcatttcttccctgctcgaatgtgataccaaatacatccttatgctcgatcggagccggctcgtatgccggatcaatctcgattacacagtaattgcccttctttttctgctttaaaatttccaaagcttcctcagtatatcccggagcaatcacaccatcggaaacctcacgcttgatgacctttgctgttgctgcatcacagatgtctgacagggaaataaaatctccgaatgaagacatacggtctgcacctctggcacggatataagcatttgcaagcggtgtaaactcaatatccatatcatcgacccagtaaattttcttttccacgtcagacagcggaagtcctaccgctgcaccagccggggaaacatgtttgaaagaagttgctgccggaagtccggttgccttctttaattcctttaccagctgccatccattaaaagcatccagaaaattgatatatccggctcttccgcagagcaccttaatcggcagatctttgccatctgccatatagattctggccggtttctgatttgggttacatccgtattttaattcatattcctgcatgattttctcctttttcaacaatccgctcttatttatttttatttattcttgtttacaattcttgactcatagtttccggtctcaatgtcaataaaacgtacaaacagggaaactttattatcctcatttaaattctcccataccattttcgtaaacgtatcgatatctccatcaatatcaacccaggttggttcaccctcgaaacttggcagtggatttccgtctcccatataagtatggataaaatgtccctctccggcaaccgggttgctgtatgcaaacgtgtaacggttgcatgcatccggatttccgttgttgctctttaagatagacatcgcataattgaactcacccttatcaatgtgcatgataccggaaatacgtggagtataatttggtgcgtccggctcaaattctctggtgcgcagcgcctgctcaaatgtctgctgcttatccatcagctcataaatcgtatcggtctgatctccgtttgtcacaatcgtcttgttgccaagtactcgaaccggtgcgtaaatgatcaggctcggatcttccagctttgacggatcaaatgcctgtgtacggataccttcgccatcctctacaaatacacgattacggctgtttgcgcttcttcccataataaaataagcagttaccgccttctttccatccttagaacgtccgatcacaataccacgtcccggatatgttgttgcgcctaattctttactgagtgctaccttctgcatttgtttctcctttcgcaaatacgcctaaaataaataaaaaccgacacatccgggaacccacatttcaatcaaatacatatttcatgtatttccctgcaatgtgcggtgcccagacggtcggcccctgcggtgcttctctgaagcatcgccttatctgcggtacatctgtgatgtatcgccctatctgcggtgcaatctttggatctgtcacctttatatctcttgttatactccacgtggttcttccacttatccgtcagtcatataactaaatttatttaagcatggaaagttcctcttgtcaagggatcttctgttatttcatcgttactattcactcacatgttactgttcacaggttacccggcgaacagtaacctcacattcagctacatgcccgtgcatattcctgtaatttttcttttgcagtctgcgacaaatgtgtcggaacctctatctgcacctgggcatattcatctccgtgaactgccggattattcatggctgctacgccctttcctttcaatcggatttttgccccagactgtgtacccggtttaatcttacagacaacatctccatacaacgtatggatctttatctctcctccgagcacagctgttgtatacggaattttcaccgtcgtataaacatcctggccttttcgctcgtaaccagatttttctccgactttgactttgatcagcagatctccgtcctttccattgtaccctttctgtcctttccctttcagacgcacagactgcccgtttgcaatgcctgccggaatatgcacttcaaagttctggctctttccgtcactggaagaaagcgtaaaccttttatcacagccaaataccgcttcttcaaagctgatcggtacttccgtctcgatattttgccctctttcctcatgtactccgccaaaaccactgccaaattctccggtacttccaaatccgcttcttccgccaaaacctccggttccgtggaatccacctttttttccaaacaatttgtcaagaatatcatccatatcggaagaaccatcaaaatggaactcctgatatccgttgcccggttctccggaagaatacgactgataaaatcctccatttccaaatggattcccgtactgtgcctgtttcatcttctccggatcaaaacctgcctccagcgaaatcggaccgtactcatcatacaatttccgcttcttcggatctcccaacacttcgtaagcttccgttacttcctgaaaaatcttttccgcatttggatttcctttattcatatccggatgatattttttggcaagttttcgatatgcctttttaatcgttgcttcgtctgcatttttatctattcccaaaacttcgtaaaaatctctttttgctgccataattatcacctcaccaatcacaaaaacaggaactgctttctaaaatgcacttcctgtcattccatctcagtcagagcattttccactaagacgtacttatatctttgcttcagttttgttatagcattgtttttagcactcgtcaagcacgtctgctaacaattttcttaattttttctaaattggtgattcacggcatggtctgaggcttttgatttttgcaaaagggacggaacacgcagcaaaacaacgacttatataccatagatttttaaatcaacacgtccatcgacaactgcaattccatccgcctgcaatagccttgcctgcgcaccttctccaccaaacgcaaattctccagctaattctccctttgcgttcaccacacgataacagggaatcttctccggatccggatttttatgcaatgcatttcccacggcgcgtgccatctttttatttccggccatctccgcaacctgtccatatgttgccacttttccgcgcggaatttttttaaccgcttcataaatccgtctggtcggactgtccgtaaccagatcatagctttccgcaatcatacgctggatttcctgctccggaacggtaccatccagaataatggtattccaatgatctttattctgatgccatcccggaatgacagatgcgtaggtacttctccagaaatcacgccactgcggatccgctttcacatttaaattaatgtatccttccctctcataggtccataaaaacgcctttttgcttccttctaccctcacaagctgccagttattatcatgaaacggtgcctcctgataggttttcggaaaagacaatgcatatgccagcgcctcttcccttgttttcatacactcctccttacggtttttccgtcatatatcatatattttctgtatatctgcatgtcggaaatcccatacatccccaaaactctccgaaccttccgttcctttttttcagtggctgcccacacaccggacaattttttatttcaatattccgcccggtagtaccatccagctcctttgccagcttttcaaaaatctgctggttcattcggcaatcgtttaatgcacggtgagccccggctgtggaaatcccgtaatattgtgccagatcccccagacgatgatgcgaaagttccggcagacagagccgtgccaatttcagtgtgtcaatgtaatcgttggttagtgtctgaccgaaataccgttcacaatcacgatacaaaaatttcatatcaaaacgattgatattatgtcctgccagcacatcatctccgataaaagcaagaaattgctgcaatacggaatcaaacattggtgcaaacgccaccatatcatccgtgatatgatttactgcacttgccgcgctgggaatcggtctgcccggattcacaagctgactgaactcttctgtaaccacgccgttttttactttgacagccgaaatttcaacaacctcgtcatatttactcgaagtaccggttgtctcaagatcatagagtacataatccggcacatactgattaatcattttaccttttgtatttcctaacatcttttgttcctttgcctttttaggattgtttcaggaaaaaacgcagacttccaattcgaagtaccgctccctgggaagccgcactgttttcaaagtttcttgcaattgtttccttttccacgcttaatgtctttacaatgtaaaattccttctttgccgccgtcggtgcattgtgcataaattgcatcacttcctgcaggtttccagatccggcataatcctcgccgagcaccgtatgggcatccttttcctgaaacacatgcggaatgaccgaatcaatcgctttatcgtaatccgcatttcccacatcgatccggatgcgcgccagacagcttccgtcccccggctgttccacctgataatccaaaagctgcaactgcccccacttctgattcactgcctcctgccattttggaaggaactgacctttctgcgcattcaaaacactgacaatcatggaaattttttgtttatttggaagcttcataagcatacccagtcccggaatcttcggaagctttacctgatcaatatttaattctgtaatatctgctaccagtcgaaacatttcttctccttcatctttggttattttctatgttatcatgctatcacttttttcgtaatttttccactaaaataacactcacaatattatgctataatttcatttggcaccgccaaaccggattcaccagaaaagtcagatcaataccgttttgatgatgatatacaggtatgtatttatgataatcttgtaatcaatatcacggaattgttaaaataaaaaggtgcttatttaagcaccttttttagtggactagacgggagtcgaacccgtgtccaaaaaccaattccctgtccttctacgagtgtagtttattctttgacattccctccgccacacgaaaacaaacatccttgtggttttagtagcttcatgatacgcccacaggtgcaaagcttagcctgcgtcgtttctcacagagtcgaagcctggatcctaaagtgtgagtgccctaggtcagactgctgccattaggcagcgtatgctaaattatcttcagcgtttaattttaattgtggaatttaacgtatcccgtacgactcgcttctccagctgcatgatccctgtcgaaaccattactagcccttgcaatgttttttgcgaagcaaaaaatattgcctcgcatcaagattttgcgtagcgaaagcttgactgcgctcctctttcctcggggagcaaaaatataactcttgcctcccgccttttttgcgaaacacctatccaagattccgcactttgaaatcccgttcggcttcccgccgctggtcttttttggcaatgtcctgacgcttatcgtaaagcttctttccttttgccagagcaacctgcacttttacaagacttcctttgaagtatacttccactggaacaatcgtgtatcctttctgcgcgatcttaccgaccatcttctgaatctctttcttgtgcatcagaagcttgcgcggccggagcggatctttgttgaaaatatttcccttctcatatgggctgatatgcataccatagaggatcacctccccattttcaatatggataaaggattccttgatgctgcacttgcccatgcgcatggactttacttcggttccagcaagagcgataccggcttcaaaagtctcttcgagaaaataatcgtgatagacttttttattgttggctattaacttcttcggttgtttcgccatcccggctccctcctttttgttctgtaaactcagtgtatatgattttcctgcaaaatgcaataaactgctgcttttattttgaaaattttaagaattccatcaattttcgtcagaatctgcaagtgtaaaatcaatcgtccgcatgatccggtcacagttatccaccgtcacacgcacctgctgccccagtttaaacctgcggttcgttgctcctcccaccagttcataagtttcttcataatactgataaaaatcatcggtgagggaagtcacacgcaccagaccctccacagtattttccagctccacgaaaaatccgtactctgcgactccggaaataacaccggcaaaggtttctccgatatggttttccatatactgcacttttttcagcttaattgtctcccgctcggcctcatctgcacgccgttccatctcactggcatgctttgcaacctccggcagtatctgcgtatagtggccaatgcgcttttcgcccagacgtccccgcagactgtccttgataatccggtggatctgcagatccggataccggcggatcggtgaagtaaaatggcagtaacaatccgctgccagaccaaaatgcccagtattttccaccgtatagcgtgcctgcttcatcgagcgaagggtcagacggctgatcagcggttcctccgaagttccgtcgattttttccagcagcttctgcagttctttcggatgcacctcatcacttcctatgtggagagagtacccgaaattattgataaacgtggatagtttctgtattttttccgaatctggctgttcatgcgtacgatagacaaacggaagttctctccagtaatattcggctgccaccgtctcgtttgcagcaagcataaaatcctcgatcagtttcgttgccacattgcggtcatacggacggatatctaccggatttccatttttatccagaatcacctttgtttctggaaaatcaaagtcgatggaaccacgcttcatacgttttttacgaagaattgctgccagttctgccatcttttcaaacatcggaaccagtggctcatattccgccatcacctccggatcatggtctgccagaatttttttcacattggtatacgtcatacgccggtccacgcagataacggactctgtgattgtgtgatcgataatttcgcccttaggattgaccgtcatgatgcaactgagtgccagcctctcttccccctggttgagggaacagattccgtttgacagggcatgcggcagcatcggaatcacccggtccaccagatatacagaagttcctctcttcaacgcttccgtgtcaagagcactgtgctcctgcacataattggacacatccgcaatatgcacacccagaatataattttcatggtccatggtaagtgacaccgcatcatccagatccttggcatcttcgccatcgatggtcaccatctgccagtcgcgcagatccatgcgtcctgccatatccgcttccgataccggctttgccacatgctctacctgcgtcatgaccttcggatcaaattccaccggaagcccgtaagcgcgcacaatagaaaggatatccacccccggatcattgatatgcccgagaatctccaccacttttccttccggattctttccctttttcccatactgtgtgatttcaacaacgactttatgaccgtttacagctcctttcgaacgctccagcggaataaaaatatccgacccgaactttggattatccggcactgcaaatccaaaatttttattcagctgatacgtgcataccacctgcttcatgcccctctcaagcacatgcagcacctttccctccctgcggcgtccggtcactgcaggtgatacggaaatctctaccgtatccatatgcatcgcaccattggtctcggattccggaataaagatatcttccttttccccctccacgctgacaaatccgaatcctttcggatgtgcctggaacgtgcctgtgatctttttctcttcggatttgctgaactttcctctctttgaacagacaatgcgcccttctgtcatcagttcatttaatatctgttccagctgtgggcgctgatccttcttcactccgaggacgatcgccagttccttgattttcatcggaacatacatatcatcacacataaagtcatatatcatttttttccgctgttcatactttgcgtccatacccagatcttctccttatataatgaaaaaagctgccgatgtaatcgacagcttccggtttctaccagattcccaaattcagaaccattgcaatgacaaggaacagaatcacaaaaattcttgtaagctttacaagcattccttccatggaacgtcccttatttttgccccagtaagtatctgctgctccggcgatcgcgccaagacctgcagatttcccctcctgcattaagataatcactgtaattacaatactcagtataataaatacaatagttaaaatcgtatttaaaacggtcacgatttccacctcctaattctaaactcacgactaactaattatatcataaaagaaaagtcttttcaacatttttttatatttcacaattttccttttcatttccactttataatataacacagataatatagaacttactgtatcattaggagtataccatgaaatcctgtcaaatgtacagatttattccgattatattactgtgtgtctgtctgttcactggtggatgttcccaaagtacgtgaacttcaccgccgattccctccctgtggccaaggccgaagaacttgcagacggtgcttccagcgatctggacatcatcagcagtgtatataattatatcattacacattttacctatgattattccaaagcttccagtgtaacaagcggatatcttcccgataccgatgaggttttcaccgctgagaaaggaatctgttttgattacgctgcagtcatgacctttctgatgatcgccgtgattctggttctgatgcaaaagtcgtacctgttttttccaaagtttatgccgaactcggaagcgagctgaccgggaccgcacggacgcttctgcacatcagtaccattctcaatcattatatgcttggatttatcattgcctttctggtattgcttatcctctgtatgattttatatcacaccgatctcgggcgcgtattgttcctcggacagaaacttgccatgacggttgcctcaggacgcgttgcaaactgcctgtatctggttctctccagcggactcgacagtaatatcggtcttaccctggcacgcgaacttgtcaataatccgcatatgcaggcacttatcgacaaatgtcacgagaatatccgccacggggaatcattcgacaaagcactgctgctgtccggcatcttttcccagatgtacgccagctggattgcaatcggttcccggaccggcgaaatggaaagcattgtttcccagcgggagatcaataccgataccgcaagctatctgacggcacttcgtgctgcattgcgccagagtccggatgtcattctccttggagaaatgcgtgattatgaaaccataaataccgctgtcacggccgcagaaaccggtcatatgatcttttcctcactccacaccatcggtgcggccaataccattgaccgtattctgccagaagcttcttccttcggtaaacggggaaatgatccctgcgtttgagatcatggtgctcacccctgccatccgcaatctgatccgcgaaggaaaagtccaccagatcaacggtattatctacacttctgccgcagaaaatatgatcgccatggacagcagcatcttacagctttataaagacggacggagcgacaaacacaccgccatctcggaagcggtcaatccggagatcatgtccaaacgtctgaatctcttataatgtttcactgatccgcagaagctggttatacttggcagtgcgctctcctctgcacggagcgcctgtcttgatccagccggcatttactgccaccgcgagatctgcaataaaagaatcttccgtttctccggaacgatgtgaaataattgccttatagccgttcttctgtgccagttcaatcgcatccatggcttccgtaagcgttccgatctgattgaccttaatcagcacagcatttgccaccttaagatccattccgcaccggattcgtttcacattcgtgacaaacagatcatctcccaccagcatcacctgttccttcatgcgtttcgtaaattcctgccagccttcccagtcgtcttcatccagaccgtcctcaatagaaatcagcggatattccgtggtaagttcttcatacagcgaaatcatttcctgtgcactgcgcaggacttcttttttttcagtggtttcctgcgttttcacatgtgcgtcagatgtataagcaccgccctgcgtgtccggacgccgcagattgacatccacctctgcatgtgtctgcgcttctcccggaaaatgatacattccgtcttcctcactgtacagctcggatgctgccgcatccatggcaaatgcaacatcgctgcccaccttatatccggcttcctccacggcacgctgcagacatgcaaacacttctcccgcactggaaaaatccggtgcaaatccgccttcatcccccactgccgtcagtttgccttctttctgcaaaatttttttcagaaaatgataaatttccgcacccatccggagtgcatccggaaacgactcggctccgaccggtacaatcataaattcctgaaaatccagatgattctttgcgtgagctccgccatttataacattcatcatcggcatcggccatttttttgcattcggtcctcccagataacggtacaacggcatatccaatgctgccgctgcgcagcgcgcacaggctaaagaaacaccaagtaaagcattggcccccagatttcctttgttgtctgtcccatccagttccacaagtttgcggtcaatctgtacctgttccagcacattcattcccaacagctccttgcggatctttgtgttgatgtgatccacaacgcgctgtactccaagcccaaaataacgttcctgtccatcccgcagctcaatcgcctcaaatcttccggtactggctccggatggcacagattccctgcccgtagtcttctttcccgttgtctctgtctgcgcggtcacttccacctcaaccgtaggatttcctcttgaatccagaatttcccttccatgaatttcaataattttgatcatcagacccattcctattgtcctccttttttcattattgtgtgaaaaagaaagaaatttattcaaatccaaagaaaaagaaagacctcccatgttatgggaggtctcttagcataaccgaccggtctgtttataggttcatttatacgttaatttctgcagtaacgccgagttcctctttgtgtgcatccagcactggacgaaccacatcacgcaggaatacttccacctgacgcggtgcacgacccacatacagctctggttttaagtttgcctcgatctgttcttttgtcagaccaaaagccggatctgctgcaatcagatctaccagattgttatccttaccctcttccttgacggtctttcctgcctgcatggacagctgacggattttctcgtgcagttcctgacggtttccaccctcttttacggcatccatcataatattttcggttgccatgaatggaatctctgccataaagtgcttgtaaattaccttcggatataccaccaggccatctacaacatttaagcacagatccaggataccatcgattgcaaggaatccttccggaaccgacagacgcttgttggcagaatcatcaagtgtacgttcaaaccactgtgttgcagaagtaatggccggatttaatgcatctaccatcacatagcgggacagggaagcgatacgctcactccgcatcgggttgcgcttgtatgccatcgcagaagatccgatctggttcttttcaaatggctcctctacttcttttaaatgctgcagaagacggatatcgttagacatcttatgcgcactggcagcaatccctgctaaaacatttaaaacacgggtatccactttacgggaataggtctgtccggaaaccggatagcaggacttaaatcccattttctctgcgatcatcggatcaatcttatcgatcgtctcctgatccccgtcaaaaagttccaggaaacttgcctgtgtaccggtcgttcctttcgatccgagcagttttaacgtactctgtacatactccagatcctccagatccatcagaaactcctgtgtccagagtgttgcacgctttccgactgttgtcggctgtgccggctggaaatgcgtaaatgcaagggtcggctgatccttatatttttctgcaaaattggacagctccgcaatcacgctgaccagttttttatgtacgagctttaatgcctcattcataatgatgatgtctgtattatctccgacatagcaggaagtagcccccagatgaatgataccggctgccttcgggcactgctgtccataagcatacacatgactcatgacatcatgacgcaccagtttttcacgtgcaactgctacatcataattaatatcattgacatgttctttcatctcatcaatcatatcctgtgtgatgaccggctttccattctcggaaagtccgagttccatctctgtctcagccagtgcgatccagagttttctccatgtggaaaacttcatatcctgggaaaaaatgtactgcatttccttgctggcataacgctcggaaagagggcttgtatatctgtctgtgctcatgttcttctccttttatttgaatacattggtaacaacttatcggctcatcttgcgctcaagatcaatctctttgtcataatactctccgcgaatgtcctgtttcggcggttccatcgggtatttgcccgtaaaacagccggtacagatcggaagtccttccgccatttctttcagacggtcgattccgagataaccaagggaatctgctccgataatctggcagatctcttcaatcgtacggttgtaggcaatcaactgctcacgcgccggaatatcggttccgaaataacaaggccataaaaatggcggagaactgatgcgtacatgcacctcggttgctcctgcatcccttaacatgcgcacaatacgatccgatgtcgtacctcttacaatcgaatcatcgatcataatgacacgtttccctgccactgcctcacgcagcacattcagcttcacctgtacgctggattccctgctgctctgctttggcttgataaacgtacgtcccacatagctgttcttgacaaaggctgtaccatacggaatcccggatgccagagaatagccaagtgctgcagcatttccggactccggcacacctgtcaccagatctgcctctaccggggaatcctgtgccagaaactttccggccttgatccggcttgcatatacactcaccccgtcaatatgactgtccggtcttgcaaaatagatgtactcaaaaatacagcgtgcttccttttctttcggaagtgccatggtcatatcggactcaatacctttttccggagaaatggtcacaacttctcccggcagcacatcacgcacaaatgttgcaccaatggtgtcaagtgcacaggtttccgatgtgataatataagaattgtcacgctttccgatacaaagcggcttaaagccgtatgggtcacgcgccccgatcaatttacgcggacttgtcacaaccagtgcgtaagctcccttaagacgctggcacgcacggcgcacagcttcttctgctgactgggaattcaaccgttccctcgcaatatagtaggcaatcacctcagaatcaatggtggtctggaaaattgctcccgtatattccagctccttacgaagctgcggtgcattgatcagattgccattgtgggcaagtgccaatgtacctttgacataatttaacacgagtggctgggcattttcacgggtagaagaaccggccgttgagtaacgtacatgtccgactccgatgtcccccttcatctgctcaagattttccggtgcgaacacttcatttacaagtcccattcccttgtaggaaagaaccttgcccttaggaccgctggtatcgctgactgcaataccgcagctctcctggccacggtgctgcagggcaaacagtccataatatattgtcgatgctacatctgcaccgtcaaaatcatacattccgaagacgccacactcctcatgaagtgtatccgcatcataactgttattctgaatcattgtgatctcctatatctatcttgtaaaaggcttacctgtcagaagctcatatgcttctttgtacttatcaacggtctttgtaacaacttcttccggaagaaggaaatcattgtccggatttgccttgagccagtctctgacatactgcttgtcgaaagaaggctgtccctgtcccggcttgtacccttccagtggccagaatctggagctgtccggtgtaagcatctcatcaccgagaacgactttaccgttctcgtccagaccgaactcaaacttggtatctgcaatgataattcctttggaaagtgcatactctgcacatttcttgtagagagcgatggtgcaatccttgatctgtgttgcgtaatcaagtccttttccaggataaattttctccagtacctctaccgactgctcgaaggaaatattctcatcatgatcgcccagatctgccttggtactcggtgtataaatcggctccggaagcttatcagactctaccagtccttctggaagcttaatgccgcataccgtgccgttttctttgtagcttgcccagccgcttcctgtgatatagccacgaacgatacactcgattgggagcatctcaagcttcttgcacatcatgctgtttccgtcaaaacgctcctgttggaaaaattccggcatatcctttacgtctacagaaatcatatgattcggaacaacatcctttgtaaaatcaaaccagaactttgacatctgggtcagaattgcgcccttgtccgtaatcctgttctttaaaatgttgtcaaatgcagaaatacggtcagtagctacaatgatcaggctgtctccgttatcatagacttctcttacttttccttctttgaatggtttaaattccttcatttccgctctccttattcttttatttttcgattaacaaactctttccggtcatctctttcggctgctctaatcccataatctgaagcagggtcggggcaatatctgccaggcatccgccctcacgcagtgtatacttcggatccgcatttacgagaataaacggtaccggattggttgtatgggcagtatgtggctcacctgtttcgtagtcaatcattttctctgcatttccatgatctgcacagataaacagaacaccatccatatccttcaccgcctggactgcatctcctaccagtccgtccacacgctcgactgccttgatggctgccggaatcacacctgtatgtccgaccatatccgggtttgcaaagttgataacgatcacatcatacttgtctgacttaatagcctcaacaagatccataccaacctccggagcactcatttccggcttcagatcatatgttgcaacatccttcggggaatttaccagcagacgtgcctcatcaacgtttggctcttccactccgccattaaagaagaatgtaacatgtgcatacttctctgtctcggccagacgaagctgtgtctttccgcactttgccaggtactcaccgaatgtatttacaatatgctctttttcaaatgcgatcagcttgttcgggatcgtctcatcatagtccttaaagcagacaaatgttgtcttaatgaacggacggtcaaatccagtaaacttgtcatcacagaatgcacgtgtcatttcacgggcacggtccggacggaagttaaagaagatcacggaatcattctcttttacaacagagaccggttttccattctctgtaattacggtaggaagtacgaactcgtctgttacatcctttgcataagaatcttccattgcctttacggcatcttctgcctgaatgccctccccctttgtcagggaatcataggctttctgtacacgatcccagttattatcacgatccattgcatagtaacgtccggataaagaagcaatctttccaacaccgatctctttcatcttcttttccagttcttcgataaattcttttccggatgcaggaggtgtatcacgtccgtctaagaatgcatgaacatataccttgctcagtccctgcttctttgccatctcaagcagtccgtaaagatgtgtaatatgactgtgcacaccaccatcggaaagaagtccccacagatgcaggtccgaatcatttttcttacaattatccatggctgcaagcagtgccttattcttaaaaaagtcaccgtcttcgattgccttggtaattctggtcagatcctggtaaataatgcggccggcaccgatattcatatgtccaacctcagagttacccatctgtccgtccggaagtcctactgccaggccggaagcctgtccttttacaaaaggacattccttcattaatttatccatcaccggggtatttgccagcgcaatggcatttccctctgtacggtcattcagaccataaccatcaagaaccattaaaacaacaggttttttgctcataattcatcctctctttccattgtaacaatcctatactattgtacttcattattgttacacaaacacttattatattacataatttggacgggattgcaagtgttcactgcaaatttcccacgatatctatcgattttaaatccagatccacatcatcaaaatactgtccataacgccttccggacgtataggcataaggagaaactcctggtttttcgacatttttatacggataaaagaatccgtcctcatcaattcccacatgattggagatgtctgccagataatgataaaatgctttgatctgttttttttctgtcagaatcgaagtcgtaagcgaatcctgtatgcacggaatcatccgcaatttcagactgccggaatcatcaatctgaatctgtgcaatcgttgtgtaaagttttccggtagaaaaccagaaatttcccacgctgtatgccaccggcacattttttataaactcaacgccctgcagacggtgcggatgtccaccaatcacggcgtctgcaccagcttttacacaaaggtctgcaatctctgtctgatcctgcccataatggatctttccttctgttccccagtgaacatacgcgatcacataatcactgttcttcttcgcacgcttcagttctttcttccatacctcttcctgctgggtctttaatactcccggtttctccttctgggctttctgtgtaaaatgataaaacctttcgatttccgttgcagatacaatcgcaatctttcgtccacctgtgaccacataacgcacagcgcttgcctctgtcagatttctgccaccaccactgtacggaattcccgctgcatgcaatgcatccagcgtatctaaaaatccctgctcaccataatcaaacacatgattatttgccacagagaccatatctattcccagtgtgcgcaggaatccggcatctttgggatctgcccgaaaacagtatgctttgccaacctgccgctgtccccgtgttgtataagcaaactcattgtttgccatcgtaaaatctgccgaaatcagttccttttttgcttcatcggaaaaataatccgccatatgattctttgccgtcttccccgtacaccaattctcatccagacagatatccccgacaaaatccagacggatgcatgccggatcggatgcttctttccagatcacatcctcatacgaatatgacatatactgttgctgcctgcaatacataagccacagaacatgcatgctgtttccggtaaaccgataccacagatccgggtcctgatttccgttttccagctgtgtatacagactctgcagcacaccgctcccatacttcgtttcaatccatcccataaaggcttcatccaccggatatttctgaaaaaactttccggaggcagtccttaaaatctggttttccagatcctgtacttccggctcggtttcctgtgattgttccgtgacctgggaggctttttcctcatattcagtttgtacttccttagtctctttcagcggctgtgtattttggatgatgccatgtgtcaaagcaaaaataaacaacaagagaacgacacattccagacattttttgttcatgtgtaaaatttcaaaggctattcacctgaaattcagatgaatagccctataaccatacaaaatcagattctagtagtttacaatcttaccgaaatcagctttcagggatgctccgccaaccagaccaccatcgatgtccggctttgcgaacagctctgctgcatttcctgcatttacagatccgccgtactggatacgaacagaatcagcagtagcctgatcatagatttcagctacacatgcacggattgcgccacagacttcctgtgcctgatcggatgtagcagtcttgcctgttccgattgcccagattggctcataagcgattaccatgtttgcaacgtctgctgctgcaacgcctgcaagatcagatttgatctgaagtctgatccagtcaagtgttacacccatctctctctgctctaaagtctctccacagcaaaggattggagtaagtcctgcctcgattgccttcttaaccttcttatttaagagaacatcatcctctttgaagtagtcacgtctctcggaatgtccgattacaacgtacttaacaccagcgtctaccagcatctctgcggagatctcacctgtgtatgcacccttctcttcgaagtacatgttctcggcaccaacctgtacgttggttcctttcacagcctctacaaccggtacgatatcgattgcaggtacacagtaaacaacatctacgctatcagatactactaatggctttaactcttctactaactttacagcctggcttggagtcatgttcattttccagttgccggctacgattttctttcttgccatgatttttatttctcctaatctgtaaataatttaactgtcttttatttatcgtctgctgctactacgcctggcagttccttaccctctaagaattcaagggaagctccaccaccggtagaaatatggctcatcttatcagcataacccatctggttaacagctgcagcggaatctccaccaccgatgattgttgttgcatcggtctctgcaagagccttagctactgcaagtgtaccagctgcaagtgtcgggttctcgaatacacccatcggtccgttccatacaacagtcttagctgtcttaacagcatctgcaaacatctctgcggacttaggtccgatatcgcatccctcacggtctgccggcatagctgtgatatcacatacttctgtctctacaggtccgtcgattggatccgggaaatccttgatggtaacagcatctacaggaagaaggatcttcttgcccatcttctcagccttagccatcatttccttacagtaatcaagcttctcatcatcgcagagagaaagtccgatctcatatccctgagccttgatgaatgtgtaagccataccaccaccgatgataagagtatcacacttctcaagcaggttgttaataacgttgagtttgtctgctaccttagcaccaccgaggattgctacgaatggacgtaccggattctcaacagcatttcctaagaaggcgatctccttctccatcaggtaaccaacaacattctgtccaccctttgcagtgatgaactttgtaacaccggctacagaagcgtgtgctctgtgggaggaaccgaatgcatcacatacatagatgtctgcaagatcagcaagttccttagagaactgctcaccgttctttgtctcctcagcgccacgaaaacgggtattctgaagtaatacaacttctccctctttcatttcctcaacagcctttgtagctgcctcgcctgttacgttgtaatcagatacgaagtttactttctgtccgagaagctcctcaagtctcttggcaaccggtgcaagggactctccttcgtttggtccgttctttacttttccaagatgggagcaaaggattacctttccaccatcgtttaataacttcttaattgtaggaagagcagctttgatacgggtatcatctgtgatttcgccagctttcagtggtacattgaagtcacatcttacaaggactctcttgccctttgcgttgatatcatcaactgttttcttatttaatgccatgtttttattctccgttctgcctttttggcaattttaaacccgaagaaaaggaaatgactttccagccggttgtttcatactccgcagctgcataaaacagcggaaccctttccttttcttcttatttgtcataatgaaaaaaggtccggccctacaggccggaccctttcacataaactaagatagattatgctaactcagagaagtacttgattgtacgaaccatctgagatgtgtagctgttctcgttatcataccaagaaacaacctgaacctcatacagatcatcaccgattgggttaaccattgtctgagtagcatcgaataaagaaccgaatctcataccaacgatatcagaagatacgatctcgtcctcattgtatccgaaggactcattagctgctgccttcatagctgcgttgatgtcttccttagtaacgccagccttcttaacaactgctgtaagaattgtagtagatcctgtaggggttggtacacgctgtgcagatccgattaactttccgttcagctctgggattacaagaccgatagcctttgcagcacctgtgctgtttggaacgatattaactgcagctgcacgggatcttcttaaatcacccttacgctgtggtccatcaagagtcatctgatcaccagtgtaagcatggattgttaccatgataccagactggattggagcaaacttgttaagagcatctgccattggagctaagcagtttgttgtacaagaagctgcagaaatgattgtatcagaagcctttaatgtctcgtggtttgtattgtaaacgattgtaggaaggtcgtttcctgctggtgcagagataactaccttacgagctccggcattgatatgagcctgagccttctccttgcttgtatagaatccagagcactctaatacaacgtcaacctttaactcaccccatgggcaattgtttgcatctgggaaagcgtagatcttgatttccttaccacatactgtgatagaatcatcgcttgcagaaacttcatctgcatgctcgtacttaccctgtgagctatcatactttaataagtgtgctaacatctttgggcttgttaagtcgttgattgctactacttcgtatccttctgctccgaacatctgtctgaaagcaagacgaccgatacggccgaatccgttgattgctactcttactgccattcttaattcctcctagaattgtaaataaatagtctcatgggacttgcgtcccaagcttcctttattttacccaattatttccgaaagttcaagtcttttctccgtctttgttaattttttcactaaaggtatctatttcccctgaaatatagtataatcttacgaaaagactttttccaaaatcaaccacacagaaaaaaggaggctcttatgctttgggatacacatatgcacacgcatcacagcggagacagtgacgcattgatgcctgacatgatccaggccgctgtacggcagaacctggatggcatctgttttaccgatcattttgattatgattacccggatgatcccgatctgtttcttctggattttgattcctatataaaagaagtccgcagttttcaggacacctgccgtgaccgtctttccattcgtcttggaatcgaagtcggtctgcagccccacatcacggaaatcaaccgcaaagcggtgaccggacatccgtttgattttgtcatcggttcctcccacgttgttcacggaatcgatccctattacccgaaatactatgaaggacgctccgaaaaaactgcttaccgcgagtacttcgaatccattctggaaaacctgaacacctattccgacttcgatgtatacggtcatctcgattatgttgtccgctacggtccggaccgcaaccgtttctatacatatgaggcctatgccgatatcattgatgagattctgcgtaaactcatttccatgggaaaagggatcgaagtcaacacggcaggattcaaatacgggctgggacatccaaacccgaccgaagctgttcttttacgctatcacgaactcgggggagagattctgacactcggagccgatgcccatgcgccggagcacgttgcatatgcgtttgaccgtcttcctcagattctgcggcatgcaggcttccggtactttacggtctttaccggcagaaagccggacttccttccgcttccggaatagcgaaaataaaggattaattccaaaaatttcaaaataggtattgcaaaatccgaataacacggtataatgtaagtattgaatggtgttatttaaatatagcatgcacgtacgcaaatgagtatgtagttcaattttattaaacaattatctaattaactactcagttactcaatttcctttaagtaactaagaaggagcaggtttcctcgcctgctcctttctttgtttttgggcttctgtcctgattcttatatacctgctgtcttttcgcggttgctccccgacctcttttttataaaggtaagaacagcaagcaggagcatgaggctgatgccaagtgctacccaccagatctgtaccaaacccgcaatgatatagccaatgatacataccacagcaacaaccgctgcatactgcatctgcgttgtcacatggttgatatggttactctgcgcgccggccgaagacataaccgttgtatccgaaatcggtgaaatatgatccccgcagacggcacctgccagcactgcggaaaccgcaatgatcatcatttccagatgatctgcccccggaaacatggcaattgcaatcggaacaagaatcgcaaatgttccccagcttgttccggtagaaaacgcaaggaacactgcaacgacaaacaaaacagccggaaggaacaggcttgcagaagcactcgttccaacgatggattccacaaatgtaccaatctgcagagcatctcccattccctttaaggtccaggcaaatatcagtattccgatcgccggaatcatcagcttaaagccttccacaaaactctccatgaatcctttaaacgtaaccacctttcgcggaagatacaaaaacagcatgacaaagaccgtgaccatggttgcaaaaatcaggctggtctccgcatcacatcctgcaaatgcactgaccacatcggtcgcaccgcccagaaatccggtatagatcatggcaccaattgcagaaccgatcagaacaatcaccggaagaagcagatcaatcacttttccgttggaagaaatatcttcttccttaaccttttcaaactcttccccgccgctggtaaacagatctccttttgcagcattctcctcatgttttttcatgagtccgaaatcaaaacctgcaataatcacaaaaaataccatgacaagcgtcagaatcgcatagagattgtacggaatcgttcgcagaaacagctgaaatcccgtaatcccggcatctttcggaacatacgaattgacggctgccgcccagctggaaatcggcgcaatgatgcagaccggcgcagcggtcgcatcaatgatatatgccagttttgcgcgggatactttgtagcggtcagttaccggacgcatcacagatccgacggtcagacaattgaaataatcatccacaaaaatcagtattccaagtcctgtggttgccagcattgcgctcttttttgacctgatcttgctgccggcccatcttccataagcagctgagcctcctgattttgacatcaatacaataatcattccaagcagcacatcaaaaatcagaatattcagattcatgctgtctttcataatcgaaaacagggcattgaatgcattccacggatgaaatccggtatataacagtgctccgaccgccactccaataaacagggaactgtatacttccttggtgacaagtgccagtatgattgccagaagaggcggcaccagtgaccaccatgttccgataaaaatcgacgtatccattttccagattgttcctctcttatacctttattttgtatcactattttaacttgaactgctgcaccagatcattcagagaatcagactctgcagaaagctcctgactggttgcggaagattcctctgcgattgccgcgttgctctgtacaacctcggaaatctggtttacaccggactctgcctgcttgatctgctctgcctgtgtctcggaaagctgtgccagttcccgggatttctttgccacttcattgattccctctacaagagaaataatcgtctgggaagtcacatcaactgcctgattgccgttttcgatttcctgaatagagttcataatcagctcacgggtattgactgcagactgtgcactctcatccgcaagttttccgatctgggatgcaactacggcaaagcccttgccggcttctcctgcacgtgcagcctcaattgatgcgttcagggcaagcaggttcgtctgctccgcgatctcctcgatctgtccgatgattgtctcaatctgcttggacatatggctgattctcttcattgcttcggtaactgcattcatttccttctgtgtcttatctgcttcctgtgcatattttacagataattcgtaagaagcctgtgcactctcatgtgtgtgctcaacctcttctgtgatattggcaaaggatgccagaagttcttccactgcacctgcctgatctgtagatccctctgccagtgtctgtgatccctctgccagattggtagaacctgcagatacctgggaagcagcctcctcaatccggtgcatcgtctcattcatatcggtgttcatgacatggattgcatcattcattgccgcaaactcacccatatatttctccgggattttggatacaccggtataatcgttgtgagccatcagatccatacggtggttgacatcctgaataacagcggccaggttctttgccatcttgcgtgcaacaactaccatctcggaaatctcatcctctgatgtcatctccgggaattcgctggagagatccccctttgcaaatgtatcaaaacgagcacccagctgatccaaaggatcaacaatattctgtgcaagcactctgccgatccggcgggctacaaaaattgcaagtgcaataaccgcaataattgcaataagtgtgatcaattctaccattgtaagaattttctctaacttatctccatgctcggtatttgcatccatcagtttcaccatatcctgataaatctcctcatagatcggtgccacctgatcctgtgccatctgctgtgcttcatggcgcgcatcaatatcctgtgtattctttcctttttccagtacagcatcacaggtgtcaaaataatcgttcagtttttctgtgatactattataaattttctcctcatccgcagatgaaaccgtattttttacctctttggtatactgctgacaggattccttcttcttctcataattttctgcgcagctgttcacaaggttttcatcctgatatccgatcgcagcacgcagataacttctcgtatcggcaaacgtaatcatcatcttgccgatatcaccctgtgaaaaaccataatttttcaatgcataattatagcggttgctgaccacaattccggatacggctcccacaacaccggaaatgctgacaatcagggccaccatcacaattgcagaagaaattcgttcttttaatctcttcttatttaacttttcaatcaacttttgtatcatataagtttcctcctcaaacgggttctcatttgtttagatattttttcagaatttcttccgtcatctcaaacggatagttctttaacttggcaggattctgcaacagtttctgcacatcctcctcccacagttcctccgggatctgtggtttgccaagcagcttgtccagataggcgataaattcagcccggttctcaaacccaagcagctcaagcacctctgccacccgcttctgattattgtaaaaacgcaaaaatcccggcaggaaaaatccgactgcctttccatgcggaatgccaagctcatatgtgaccggataacttaatccgtgcggaatactggtaccggtatgtgcaatcgccatacctgccacaaccgatgcatgcatgaatgtttcgtatccttcatccggaatcttaatcccggaagaaagcaggtattcctttgcactgccccagatccgaagaccttccgctgaatatatccggttatatgcatttgcattagtattcagatatgactcaatcagatgtgccagcgcatccacacaggtgctgaccatattctcataagaagaagtctttaaatatccggcatccacaaatgccagatccgcaaaccatttgtgtgcgattgactgcttggtatgtaagtcgtgccgtgtcagaatcgcataaggcgtcacttccgatcccgtaccggatgtggtcgggactgctgcaaccggatagccctgcatcggctccggatgataaagacgctcctctgcatgatcgattgccgatggattcgctgccagaagcgaaatcgccttggacgcatccatcggagaaccgcctcccacagccacaaagaaatccacctgttcttttactgcaatgcccgctgccacagccacggtctccacagaaggattctcttcgatctcatcaaaaatcacataggtctgcccgtttgcctgcaatgcctgttcaactgctgcaagcgaaccattgatgcggctggaatgttttcccgtcacaatcatggctctgcttcctaatgcttttaactctgcaccgttttccgaaacacaaccgctgccaaaaaataccttcgtcggcatatacaatctcatgtttcttctcctttatgcgttgcacatctctgtaacaacttcattgatcacctttccgtctgcctttcctttcagctccggcataatcgtcttcatgatctgtcccttgttcttcgttgcaatcacatctgcaaacttttccttaacaatcgcagtcacttcctctttcgaaagcatcttcggtgcatattctttcataatgtcataacgttttctgtactcctccagcaaatcggtacggtctgccgggcaggaatcgatctgttcctgaacggtctttaattccttcatgattgtggcattgaccatatcctccggaatgtcatctctgcatccggcatcaatggcatttttcttcactgccgaaaccagagacgaaattgcatccttccgttccttgtcgcgcgctttcatcgctgccatcatatctttgcgtagctgttccatctgcataatttcctaacctccatgtctataaaattcagataactacattatactacgcttcgggctgatagcaaagaataaccttacattttttaattatatgaaaattgcaaagtttaattctaccatccatttatacagtggaattctcttctgaatacccgtgactggactttcaccagtaagattagtgccatgctcggcacactagaaaaaatgactctgtgggatttgcccacagagccattttttctatatgccttttatttcagatatccgtttgtaaccatatctacaatctcacctgtcggaatggaaaattcgaccattcccatatatcccggtgctacttcatacttatcaaatacaagggtaagttttcccttctcattgacatagaaattcgtcttattgctgatggacttgaaattgaacttattgttttcatcgtccacaaaataggtaacatctgcattctctttcatctgtgcccgcatctgttctttgatattgtcggaaatccggtcaatatagccgcttccttttttgaacagatttttcagagtgatttgttttccggattttttatccacactgaaaatctttgcataactctgggagccgcccatagcaattaccgtatcaatccgcaggcaaaacagcttgtcgttgtcggttacaaccttatatccggaagtaaggctctcatttcctttctctcccttctttatggctgccacatcttttttataatctttgataaatttgttctgataactggaaatggcagcattcagtttttcactttcgcttttcatgacttttccgtctgtacctgtaattttcactttcggaatctttacactggcttccatctgtttgcccttctggttgttggtatacttctttgccagcgatactttataaaccggcagacttgtttttgcctgtgtaaccaccgttcctgctcccattgtcaccagcattgccgcagcagctactgcaatacctgtcttttttaatacactactcagtttactcattttattttcctccttttttgtttctatctattagaccattcatcacacataaaagtttcagaaatacaaaaatttccattttatttttctgctgcccggcttcattgaaaaaaaacaggaaaaaagctataataatataagtttgccatataaaagcaaatacagatattaacataagaaagggcgaaacatatgacttcagaacaacaaaatccacttgccgtggacaaaatttcttcgctgattctgcgcttttccgtaccgagcattatcgccatgcttgtcagtgcggtatacaacattgcagaccagctttttatcggaaatgcagtcggcacactcggcaatgccgctaccaacattgcattcccacttgccatgatgtgcacaggacttggacttctgtttggaatcggcggtgcggcaagcttcaaccttcacatgggtgccggcaaaaaagaaaaagctccctattttgtcggaaacgccatcacaatgcttcttaccgttggcatccttctttttgccataaccgaattatttttgaatcctctgctggtcggatttggttcccctgcagatgttctcccgcttgcccggcaatacgtccgtgtgacggcgatcggttttccttttttaattcttacgatcggaagcggacacttaatccgtgcagacggcagcccaaagatggcgatgtttgtaaacatttccggcgccgtcatcaacattgtattggatgccgtgtttgttctgggattccactggggcatgtacggtgctgcagcggcaaccgtgatcggtcaggtcatctctgcgattattgcggtctgctatctgtcacactaccgcacagtaaccctgcactccgagcatttccggccgaatgcttcccatctggcacagatctgctcacttggcatggcttctgccatcaaccaggttgccatgatgatcgtgcagattacgatgaacaacctgctaaagcattacggtgcacagtccgtttacggagagtcaattccgattgcctgttccggaattgtcatgaaagtcaaccagctttacttttccgtgattatcggcctgtcacagggcagccagccgatccagagttttaactacggtgcaaaacagtacaaccgggtaaaggaatcgtatcgtctggcgattacggtcggtgccattgtatccattgtatcctttctgctgtttcagatttttccgcgacagatcctcggtctgtttggcagcggaagcaaagaatattttgatttcggtgtaaactatttccggatttttctgctgtttacatggcttaattttatgcagccgatttcctcgacgtttttcagttcgatcggaaaagcatataagggaacatttctttctctgacaagacagattttattcctgcttcctctgcttttgcttttcccgcgtttctggggaattaagggaattctttatgcgagtccggttgcggatgtgttatcttttgcagttggactggcaatggttatacatgaattccagttgatccggaagttggaagtttctgaacagaatacaacgactttctaacatgaaagtaaaaatatattttcctgcaaaaaagcgcgcagcaaaaggggggcaccactttttgctgcgcgcattttttactgtttcaaatcggcttttatttatttttgagccccgatatgagttctcagcttatttttgatctcattctcaagcttctccacaaactcatccagtggaagaactgtggtatctttttctccatgcagacggaaggatacggttctgtcttctttctcattgaagccgacaaccagaagatacggcaccttctgcacctgtccttcacgcatacgatagccaagcttctcggatctgtcatcgagttctacacggacatcctttgcctctaatgcatcgcagatttcctttgcataagcagtcagttcctcgttgtctgtcttaaccggcatcacacgaacctgaaccggagccagccatgtcggtagatttcccttggtctcctcaagaatatatgccatgaaacgatcgagggaaccaaggattgcacgatgcagaacaaccggtgtcttcttctcaccatcacggtctacataagacagattgaattttgccgggagacagaaatcaagctggcaggtagaaagtgtgatctcattgccgactgcaggctgtacgtttacatccagctttggtccatagaaagcagcctctccaatttcctctgtataatcaattttcagatcattcaataccgtgcggagtgcatcctctgccttgttccacatagcatcatcatcatgatacttttctttgtttgccggatcacgcagagacagtacacaacggtaattggtaattccgaaatccttgtaggtactaaaaatcaagtctacaaccttggtaaactcatcctcaatctgctccggtgttacaaacagatgcgcatcgttctgacaaaaatgtctgcctcgctcgataccctttaacgttccgctggattcgtaacggaaatcatgtgcgatctcaccgatacggatcggcagatccttataggaatgtcttctgtttgcatagatcatcatatgatgcgggcagttcatcggacgaagaacgaaagactctccctccatctccattggtgggaacatgttttctttgtagtgatcccagtgaccggatgtcttgtacagatttacggtaccgacacaaggagtcataacatgcagatagcccagctttctttccttgttcttgatataattctccagctcctgccagatcacatatcccttcggaaggaacatcggaagtccacggccaaccagatcatcaaccataaacaggttcatgtcctttccgatttttctgtgatctctttcctttgcttcctctaaaagcttaaggtgtgcctccagctcctctgcggtcgggaaacatacaccataaattctctgcagcactttgtttttgctgtcacctttccagtatgcaccagagtgacggatcagcttgaagtttctgcaaagttttacattgtctacgtgcggtccacggcacagatccgtaaaatcgccctgatcatatacggtaatatttccatcttccagatcggagatcagatccagtttatactcatcattcttgaacatttccatagcctctgccttagaaacttcacgtcgcatgattttctttccggattttgcaatctttttcatctctttttcgatcttttcgatatcctcatcacggattacatcttccccaagatctacatcatagtaaaatccctctgcaacaaccggtccaacccagaattttgcctgtgggtacagatgcttgattgcctgtgccatcagatgtgcacaggaatgattcagtgtttttaattcttcattttccttaaagtttaccattttacgttaactctccttcttttggtatggaaataaaaaagcaccccggatatgcataacatatctaagggtgctttatacacggttccaccttaattcttttactctttggcttataacgcagctacacggtgacgcttctttcgcgcacagctcaggagtggtcttcatgaaatctttccataaacggctcacaccatctaccgttctctctgtatgtttcaatttcactacttgttccgtcaatgcttttttctattcttatgcattgtaccacgttctgatttctaatacaatagggtaattttgctaatctgctttttcatccatataagtaattttcagatcgaacgaccatggaatatcggaaagatactgttccttataataattgtttccgtttgttatttttttccggaagcggaaggaatccggcgtaaaaattacaagcagatatgtatttcctttctttaagcgatacgtatttttttcagattccatactgtatctggaaatactgtcttttttcttctgcagttccctctggatagcgcttgtataccctgccgaattttttattgcacgcttcgcacttctcgtaagttttttcgatgcgttgacatcataccatactttgccataaccacttgcaaaagttctggaaagaaactgatagtaggtactgttccatgggtcataaatctcatacccgctttttaactcttttggcagaaacatgagataattgttatcattatagatcacttcattcttggattttcccttaaaatcactttccgtaaactggtatttaccgctctttctacattgaaattttacaaacgagacattttcaccaacaccatcatcatccacataactggtatttgcttttccggtcataccggacacattaatgacgttcctgccctcatacaatgccgggacctgctgcatcgtgtaattatacacactttttgaaatcagttttctctcataggcgcttgtctccagctgtctgtaagtcagcttgtccgcattggacttgtttaccagatttcccgtcatcaatgctgttaccgaatgtaccattgctgcatctgtgtgctccatttccattggtgtcacagcaattactgccagaatcacagccagaacaaaacaaaccctctttttccacatttgtctgagcataaataaataatccttttttgttattattttattctatctttccgattccttcaagtactttctgctctattttcattatctcataaataaaaccatcagccaccttaccgcaaatgctgccacccaggcgatcatacactgccagatcaccatgccaactgcccattttcgtccaagttcccggcgaatggaagcaattgctgcaatacacggcgtgtacaacagactaaataccagaagtgaagctgccgctaccggtgtcaatgcatcctttactgctcctccaaataaaatttccagagttgagatcacgctctcctttgccataacgccgctgatcaatgaagtacagatcctccagtctcccagtccaagcggtgcaaaaattggaaccaggcagtttgaaatcatcgcaagaatactgtctttagaatccgccaccagattaaaatgcaaatcaaatttctgtaagaaccagatacagatcgttgctacaaaaataacggtaaatgctttctgcaggaaatcttttgctttctcccacaaaagctgcataacatttttcagccccggcagacgataatttggcagctccatgacaaacggaaccgcatctccacggaacagtgttttccgatacaacaacgcaaccaggattccaatcacaattccggtcagatacaaagcacacatcacgagtgctccatactccgggaaaaatgcgctggtaaaaaatgcataaatcggcagttttgccgaacagctcataaacggagtcagcaaaatcgtcatcttccggtctctctcactcggcagcgtgcgggtcgacatcaccgccggaactgtacatccaaatccgatgagcatcggtacaatgcttcgtccggaaagtccgatttttcgcagaagtttatccataaaaaatgcaactcgcgcaatgtaaccactgtcttccatcaatgacagaaagaaaaataatgttacgataattggcaggaaactcagtacacttccgactccggcaaaaataccgtcaatgatcagtccgtgaagcacttcattgactcccgctgccgtcagcgcacggtctgtcacattagacagtgcgtcaatccccatggcaagcaggttctgtaaaaaagcgccgatcacatggaacgtaaggaagaacaccaacagcataataccgataaaacatggaattgctgtatattttccggtcagaatccgatcgattttctcactgcggatgcgctcccggcttgccttcggctttactaccgttttctcgcacaccttttcgatgaaattaaaacgcatatccgcaatcgccgcactgcgatcgagcccacgctctttttccatctgtacaatcagatgttcaattgcttcgtgctcattctcgtccagttccagtttctgcagaatcagatgatccccttcaatgatcttagaagctgcaaaacgcagaggaattcccgcatgctctgcgtgatcctcgatcagatggctgactgcatgaatacagcggtgcacggctccaccaaactcattttcactacagaaatcctgtcgtcccggccgctcctgatattttgcgatatgcagtgcatgccttaccagttcatccactccctcattttttgcagcagaaatcgggaccaccggcacacccagcatcgcttccatcccgtttacatccaccgatcctgaatttccggtcatctcatccatcatattgagtgccacaaccatcgggatatccatttccagcagctgcatcgtcagatacagattccgctcgatattggttgcatcaataatattgatgatcgcctttggtttatcctccagcacaaaatttcttgaaacaatctcctcactgctgtaaggggacatcgaatagattcccggcagatctgtcaccagagtgtctgagtatcctttgatcggtccatccttgcggtcaaccgtaacccccggaaagtttccgatatgctggtttgaaccggtcagctggttaaacagcgtcgtctttccacaattctgatttcccaccagcgcatatgtaagcctcgtcttttccggcaaagggtttccatccccttttacatgatactttccttcttcgcccagtcccggatgaaccgactgattaatgtttctggctccttcatgctttctggtacgggaagaaatctgctcaattgtaatctgatctgcatctgccaaccgaagagtcagctcatacccatggatctgcagttccatcgggtcgcccattggagcaaacttaatcaccgtcacttccgctcccggaatcactcccatatccaggaaatgctggcgtaacgcaccctcaccgcctacggttttaatgactgcacttttcccgatttccaattcttttaatgtcatattgtcttatcctttgcattctttcttttgtgttattgataatttttcttaattatacacgtaaattactaaaagagaaagtttttcaataagaaaatatggaaaagaacaagtctataaagttagttttttgtacatggaaattgtttcttcattcgtctccccgtaaataaaataatagtcgatctgatcctcgcccagtgtactgatgtaaggcccataggttttgatattacagagcaaaacggtttcttttgccgctatcccaagcccataccccttcccggataaaacaagaggcatccgcataggctttcctccaaaagaaatatactttgcctttgcacgcagcacgagcagatccgtagaaagaattccctttgcattaatcttttccgaagaatcccattcaaaaaattcccaggtctgctgatccataatcaggcgcggttccacggagcgttcctttaacagtaccgtcccatctgctgtttcaaattgtatggcacctgtttttttatcaatcacagcactgactttttccgtggaaacttttaatgccgtctttgactctctgacactccacgaaaaaacatccgttgcctccggtttccagtaggtatccttgatttctgtcgtcacacctttgacgaaacttacccttatcacctcgggtgtcatcggtgtcagccgaagaattcctgccatacttgcaatgtctatatgctttttcgtttttttggcccatttcaccgtataattcatgcgggaatgtccacgtaccggtagcaaccggttatccggcagatccccaaatgcataaggagacggattgatctgcgcaatctccggggccttcgacacctttgaaaccggatggatgtcagatttctctttctcggatacagacttctctgaaaccggatggatgacaggtttctctttcttgggtactgacttctctgaaaccggatggatgtcaggttcctcttccttcggtgcagacacctcgatccgttccggaccgatataacttcgcgcattgcgttccttatctgcctccgtccgtcgctgctgctctatttctttttgcgtaaaggttttcttttcatattcctttgccttggtcagtgtttctactgcaaacactttctgctttttctcttttgaaaccggatctgtcagaattctgctcagatttccgtgatacaacaccacaagctcatgcagcgcgcgggttgccgcaacatacaaaagtttcacatgtccgttatctgccggatattttttctgcgtcggatcatacaaaagaaccgcatcaaactccagacctttcgtgtaggcaaccgaaagcaccataacaccgtctccaaattccgtagtccccgggttacagtccacaatctccatataagatttcaactgttccgccagctctgctgcctctttttcctcacgacagatcaccgcaatcgtttcatatccatcttgctgccacttccggatcgtgtgtaccgtctcttctaaaagcgctgttgcatccggctgtttctccacccgcacggctgctccatgccggataatcggttccaccggatacacagcaaaatctccatgccgcaaaatatcatttgcaaattcggaaatttccaccgtattccggtaacttttccgcaacagcccaaacgcatcatacgtgccggtcagcaccagtttccgcaattcctcccagtcatttagcccataccggaaatgtatgttctgggaggtatcccccatgatcgtgtatgtgcatccccgcagacaatagtgcagacagcaatatgccatcattccaaaatcctgtgcctcatcgatgaccacatgactggcctcccgcaccggatcagtttccttgatccgcttgtaaatataggcaagcgctgcaagatcgtatacatcaaaagaagtttctggtatatctacttctttcccggcaactgcctgcacctgtaagaattcccggtaaaaatcgtaaatagatgtcttccattttccatctccaaaaaaagaagcatatttcttatccagtgccttttttacttttgccggataggatatttgttttcccagaacttcgttttcgtatttggaatataaaacctcgttgagcataagaattttgctctgcatggaaagatcgggatgttcccgcagataagtattgatcagcacatgcccgaccagaagtgtctttgtgttttccagataaacttcctcgtgtgaaatttccctctgttcataagctgcacaatataattccagatcatgaaaccactcacggtttcctttctgcgcattcttttcatcatctttttccaggaggtgaaaacgatatttccgttcatcccaatcctcatacaacaggcggatgaacagctgttccatcgtcatctgccggatgccatacacatccagttccggcaatacccccgtaatgtaattcaagagtatccggttgctccctataatatagaaatcttccggccggaaatcatcgctgtaattgtataaaatataggaaatacggtgcatggcgacggttgtctttcccgaaccggctacaccctgtacaatgatattggtctttggcgaacgccggataatcagattctgttctttctgaatcgttgcaatgatctcaccgagcaccgccttcttgtttttcgccagatactttgtcagaagttcatcatttgccaccacatcggaatcaaaaaaatctttcagatgatcattttcaatctcatacgtgcgtttccgtttcaggtcaatcgtaaaggttccctccgaactgacggtatactgacatggtcccagaccactctcataatataccgatgcaatcggtgctctccagtccaatacgaccggttccgagttattttttgcaattcccactcttccgatatagtaagactcgtccccttttacattcggatctttgaaatcaattcgtccaaaatacggtttcctgcgcgctttctcataacgcaccagatcatactcattttccttcagacgcgcggttgcattattccacaacgccaggccttccttatcctgtgcctcatacacgtccagcaggtcttccagatcctcgttcactttccggatatctgctctggcgcgttcaagattttgctgtgcaatcccgataatctcctgcagtttttgttcttcggcctcccgcgtcagtcccggaagcatgtttttctgttccaaatgtattaccctcctgtaatttacagaatgtttgaaagacacaggtttcgcaaccggcgtgtcagggaaaacgtgcctgcatcttttttctgtgctcccataaggatcgtgatatcctgttccggcagatttgcaaaatatgcgcccagccagccatcccagccatattctccctttacacagattccctgctgcaattcaggtgccacacatctccgcataaaatttgcataggtatacccttccagtccgatccactgctgcattgcctgctgctggtttgccgacatactgccagcttgtcccaggtgcaaataccagtggacatgccgcaattttttctgccatttcctgtgtgctcaccgggtgatcactttccagacgcgcacacgcttcctcaaacacttttgtgactgcacgtccacccatggtctgttcctccggatataccagcccggaagtcatcgccaaaagatcatgcatcagtatcggcctctccggtgtatacaattttccgtctcgctccactttctggtgtgcaaatgccggaaggatatccgctaccggctcgtacagatcaagcattcctctttccatcagaatcattgccgccactgctgtaatcggttttgtcatggaatataaccggaaaatagtattccgttcgattggtttttccgcttcccggtccgcccttccagcctgtgcatagaccagttcttcatttccttttgttatgagaagattagcacccatgacttcgccggaggcgatggaatgtaatatcagatctgtagcctgttgcgttaattttttcaacattttttctccctgtttcatcccgtttttcactatttataaaattttactcttaattcgtagaatgtgcaatttattttactttaaaattaaaaagaaacggtcaccatactttcaactttaaaaatacagtgaccgttctactcggtttcgttattcaattttttattcctttcttttgtaatttaattcttccagctcacaaatgtttccacctgtttagaaaattagtgatatgtatgctctatattgaataataatctgaagtatgctctctcgctttttatagaatgaacttcttccgcacatcctaccctcaaattaccttccgtggtatctttccgcagtatcttcatctgtaaaatgtctgtacatatccattgccttccatcgtctctgttatcctctactaataactttaagaattattctcatccatttgaaaaggcttttcctgctgaaaactatcagacactaccacgcttaccatgaagtttttgttttgatcatcgtcccattggactgtacctcctcttctcattcaattcctgcttactccaagcttctctttatttccaattggcttcccaaccgcttggttcgattggaagtcttgtgtaattaggtcttgtttgttttgttgactgtatattaccatatgcgttttatattgtcaactattttgcgaaatatttttatttttttctttttattatttatctgtattcaaattgtgtgtattttatattcaaatatgtatttttaactgaaagtttaaaatgcaaaaaacacggcaaaaatcctgataatacagtcccatcttctttaaggtttcatcgattcccgccattgcctgctcatatgtcttgtgctctgctgcaacttttgacacaacaaataagtcttctctcgggattccacaggtgcggaccccttccccgacaccacgctcattaaaataactctgcgccgtatcaattgcacggtatccaactttaagcgcatcgagtacgcatctttcacattcttcctttgtaacctgatatacgccgtatccgaggatcggcatcttaactccattgttcaatgtaacgtattccatttgcaattcctccttcttgaaacatcagcccatttcattttatctgtccttattataaagaaaacgagacctgataagaagtctcgttttgttatgcagtataaacctttaggtttgcgcttatacacacatccttatttgatctgccggatagcctttatcaatcgcttgaccttatccgacggggttttcgagtgaagtattccaaacggcatggtgtaatcccattccaccggaataattttgatcaacggatgaacactttcccagcttttgaacgcaagaagaacctcattctcattctcacaccagttaaacgcttccacattatacagatcaaaatctacgatgttgatttccggatgattcctgatcatatcatctcttaaccgatctccgtaataactccagcctctttgcatgagcatgaaattttctcccgccagatcatccaatgtaatctttttcttttccgccagcctatgatgaatcgatacagctacacaaaacggttctcttgagatctcagtgccgtcgcatcctctgagttttaacattgtttcatcaaatattccggctacaacatcgatattctgccccagatttgccaatatctctcttgcattctccaaggtattttcaaatgtgatcagcttaaactttatatctggatatagattctggatctgtggccacagatccacaaatacctgtggcggcgtcatcgtcgagattccgacgcgtatcacatcgtccgatacctgcattgcctctttcgcccgctgcaccgactccttgcaatacccgatgatatattttgcgtcattgtagatcgactgtccggcttccgttaccacaagccctctgtgcgtcctgtcaaaaagcttcataccaagacttgcctcaagcgaattgatctgtttgatgaccgccggagccgatatatacaactgttccgctgccttgctgaaacttcccgcctcaacaacgcacaaaaacgtatccaactgcggattatacatcatgtccgtttcctcctacaatgaatttaacactccctggattccgtcacgctcgtagattcccttataataggcaacttcctcctcgatcagctgatcgatcacctgcatgccgagaagttccaccggagctttatcatccgtcaaaatataatcgccttttccatatggagtgctatccgcgtataccgtctccatcatgtttcttaaatcagcatttgtgatctgctttgtatttgcctgcagattctccatgatcgacggattgttcgatgcaaaaagctcgcggttcgtcgtattcgccacatcaaccgtatactccgcgtcaaacacctgaccgatcgtatcggagagatactgattgatgttgccatctccgctgccgcgcatgttcatatttacgaccatcacgccgtcctcgttcagatgatccttaaccagtgtaaaaaattcaacggatgacatctggaaaggaatcgtgatatcctgataggcatccaccatgatcacatcgtatttcttatccatcgcattcagataagctctgccgtcataggtcgtgaccggcacatcctcggagagtgagaaatacttgcgcgaaagctgcgtgatcttctcatcgatctccacaccttccacgttcatatccccgagatacttccggcactgtgtcgcatacgttcccgttcccattccaaggatcagcacatccatatccgatggcttcttatccgccagcatgagcggtgccgccatcgcgtaatcataatacatgcctgtcagcctgtcctgcttcatatagaccgactgcacaccaaaaagcacgttggtcgacagtcttaccgacgtgtcatcttccgatacctgcagataattgtagaccgattcaccctcataggtgagattcttctcccagaatgcaaacgaatccgagtaaccaagaccgcagcacagtgcaaagattaccaccgatacgatcactttctttttgcctgcgcggacattgacaaaatacacgattgccagaaccagtagaattcccgagaagatcagaaacgtgatagacgttccgaccgccggaatcgtcacgaaggttggcacaaacgtaccgatgatacttccgatcgtgttgaatgccccgagtgtaccgactgtcttaccgttatcatccagactgtccaccgcatattttacaagcgacggtgtcacggttcccagtaagaaaagaggaaatacaaagatgaccatacatgctgcaaacgctgcaatgatcaaaaaatgattgctcaccgtaaaaatcaaaagtgccgagattccgagcacgatatatttgcccaccaccggaatcagagcgatccagatcgcagcgatcaggattctcgtgtacaggcggtccggattcggcgacttgtccgcacttcttcctccgtaaatattgccgagtgccatcgcgatcatgatggttccgataatgatcgtccagacgatctgcgacgaactgaaatacggtgccaacagacggctcgctcccaactctaccgccataacggacattcccgaaaaaaactccgtcagatacaaaaataacttattctttaaaattacggtctgtttcatattgcctccctgctttaagctgttacgtttatattacaacttaaagtagggtccaagtcaatacttttcttttcgagacgcttctgggcttctttcttctctttgatgcgtttttgcttatgcatctctaagatctttttctcccacgtatctctcttgtccttgtccagcttcgttttttcgcgcgactcatccccgttatcgtcttccgtgatcgcccagccgctcacactgccatccgcattgatgatcgttcctgccgctttcacatgggaaccggcaggcgcccagtccatggcgccgcttgagatcaattttgcgcaatcatagatcaaagcctcatactcgatccgcttgtccggattattctgcatctatgccaaaataatcggtgtgatctgaatgttattcgtacctttctgcgaaaaagcctgcgtgtttgtcgagaagttcacgcccgggtagcgatccaagagtccatttaatgtcgcggattctccactgtccgctttcacttttgcataactcagtgctgcttccgacacccaactgtttccaacttttactgccatgttttccctcctgttatactcttactgaatgtacggatattcgtatcatacacatttgcaacactttcctgcatctgtgccttttttcgtgctgcctcccactgcgccttcatcagttccttcattctcttcctgcatattctttaacatcactccgtcctcctgttctttactgaaccaatcataacgctgattctttagaattactgtggtgttaataaacagagatatactctttattttagtgatactgttgcatgtgcacaaccaatttcatactgtccgtttttgtgtatgcgcttacaagatcatgtacgaaaaataaggaagggtgcagtctgtacacccttccatgcagtttcaaatcatacaaagcctgttcatttctctctcataccgaaacggatgatccgacagaatttcatctgctggaacttcttcccgattgacactataaaccatttcctgtagcacctgttcatccagccatgtcttttctgacatgacaattgtttcatgtatactacacggtataatgatatgatttccacctgccatgtctgcaataattttgagaagtccatcataacagatcacacctgcaccatttattctaaagatatttgtcaatatcaacatgtcatccacgccttccctgtaccgcaatcactggttttattgaagccccatcatgtaccaccaatcctgcgataaaaaaatccagcttcacatgagccggactttctattgccattatttagtttttctgcctccataatcaatccttgcctttctctctgataaaatttataattgtttcatgcttccgcttcgtgtaaccgaagcttttgtttatccatacttcatagcctttttgctcctttctgtaattgctttagtgataaaaagaattactctcttcactaataggagaaatacggctacaaaatcggaagtgttttgaaattatttttgaaaaaatttttaaggactgattaaattgccaaaatatgaggaactaaaagctttccgcaaacaaaacttaataccggaatacaacgattcttccagtgagaaaactatgctgcacagggaagcccgtgcattggcaatcagccgtcttgaagaaagtgcacgaaccgaggaagaattcgcaaatgttatatcgtggtgggataaacttgatgacaacagggaacgcagagagcggtaccatgaaatcggacgctctgaagtaccgcttgaatggcacgcctctgattatatcctgcccggtaatgccaactatgatatggtgctgtggcagcagatacttgccggcgattttattgattatatctttgatgagccggattacatccatgagcttgtacgcagtcaggatttatgcctgatattaaagaatatgaaggaacaccagaaacagcttttgtactatgtggttgtccgttcatattccacactccaatacgctgagttgaacggaaagactgaccgcaatgtgcgtggtgtgagggaaactgccataaagcagataagaaagaaatataagactgctcttgaaacaaggctgcttcatctgccttggacacttacattggacgaaaaatattttcttgaaaacggggtaagaactaaagacgaaaagaattctgaaaaacagtgactatgctgcctgaaataaataacagggtaatatgatacttttaatgttttgtcaaaagaaaattgcgttgaaatttcagaatgataacccttgacctataatgtgtaatcgaatagaattgttaatagattacagtttctttatatagaagttatacgaattgaatttcagacgattgctctgattccagtgaaatcagattggaggcttttcatgaaaaatctatttgaacataccagttccccatggatacggtacagcagttatgaataccgtaccgccgaggatgggactttatatattgtagtatctgcggatgccaaaccagaaatgtataatcctatgaaagatgcagaatcacttgtactggatgctgtcaatatcggtttgcaggtcatgcataaagcaccagaagatgaactgaaaagtatggttcttcgtttcatcaattcctacggatttttaggctttatgactgcacttccgacaactgcggaatttatcacctatgaatctgtatatcttccaaaaaaccattttattaaagaagaatctctatcaacagaaagttatctcgattatttttatccatttgataagatggattttcacaaaaaaggggtagaatcaagttggtcggtatccgacaaggatggcattgcaatcgcacttgcaacgggaaagaatccacaggctgttacgatgagttttcagaaggaatatgcagaacgctatgactggctggtgaaagaattttccgactgggcgtttacctttactacaagcttcttatattatttggactatgaccgtctggacgaacagacaaaaaacctgtatcgtcagggtatgtctgcatttggcggcatatccccgacttaccatatcgcattagcggaaaataccccggttatcgtatggaacttccattccctgctcgtcatgatccagatgtgcttctcttttatgcttacggattctgactgcgatatgaaactgtgtaagcactgtggcagggcatttatcgcaagccgtaagggaaatgagttctgctctccgaaatgcaagaatcagtataatgtctataaaacaagggctaagaaaaataaaacagatgaataatgaataaatgacatatctggaggaaatactatggacaatatgattagaattgataaagattatgtcgaatggctgaaacatgttaaaaaaagatttaaaaatacacaaataaaagcatctatcaaggttaatgacgagttgcttaggttctactggtcaatcggcaaggatatcgttaacatgcaggctgaaagcaaatggggcggtgctttttttgaaactttaagtgaagatttaaaaaagatgttcccaggtgcaaaaggattttcaaccactaatttgagatacatgaaaagatactacaatttatttggtgaaattctgccccaacttggggcagaattaccggaggctacaaatctgcctcaagttggggcagaaatatatgccattccatggggacatataaaattaattgttgataaatgcaaagatgaacccgaaaaagcaatgttcttcgttgatgaagtaataaagaataactggtcaagagctgttcttctaaacttccttgacactaatctatatgaacgccaaggcaaggcaataagtaattttcaaacaacactaccggcttacaccggtgatttagctcaggaaataacaaaagatccttacaattttgattttattgctttaaatcgtgactataacgaaaaagaattaaaagatgccctgaccgaaaaggttatgaatcttttaattgaaatgggaaaagggttcgcctttgtcggtcgagaataccctttacctatagaaggcacagaggaatatattgatttgttattctaccatctaaacctacattgttatgtcgtagtagaggtcaaaataaaagaattcaaatctcgtgatattggtcagataggtacttatataaacattgttgacgatattgtcaaaatggattccgatggaaaaactattggcttgatcatctgcaaagaaaaaaataatgtattagccaaatatgctgttaacagttccaacgaaccaatagcaatttcagcatacgaattatcgaatttcttaccagaaaatcttgcaacattactgccttcaacggatgagctggaatctcgattactgctagatgaagcagtcaatgagaatgataataacaaccaatagctccattctcgtatatatggtaagacaaagcaggaaccatgacgattcctgctttattcttatctataaatcagatcatgcaacactacttcctctgctccggatgttattcatcttccgcacccatccgagctgatctactgacttcaaatgctccgtcacaccttcacgctcagccattcttaccgtaagcatatccatcatgtcattgcattccatatctacttcttccagatgtttccacaatttttccgtaaggaccagatgtgtatacatggcatgatgattttcaaacaaatacctctgtcgcattctgccatatttgccaatctgataattgcttccatcttccaattccaaatctggaatcaatacatcgccttcccaatgatatgttaactccatacgctgctctttcctttgtgctaaatgtttacagtttcaattaaaagagtatcaccttcttaatacaacatctgcaatctatcattcaccacaaatgagccagccgcctatgttgtgttatatccgcgaacaatgagccaagctgacacgctggcgtgtcaatttggcgaatgtcgcgagagtcaaatgcttgcatttgactagcagatggaggtttccgctaaacaacactgtttgggaaatctgacatctacacttcacaacatatcacttcattgccgtacgcctgcgccgtatcaatcatgcgataaccaatttttacgccttctcttaccgcttctgccactttgctatcatcgataaaccaggtaccgagtcctaatttggggattttaattccgttttccagtgtatatgtattttctaacatgtttttcttcctttcaatgtatattttatatttatttatacttccctatttttcctcattccatacttcttttgccatgcggaacactgcccatgctttcggccatccgcaataaaacgctgcatgtgtaacgatctctgctatttcctctttggtaataccatttgcctttgcactctgcagatgatatttgaatgattcatcggtaagtccctgtgccatcagtgccacaaccgtcacaagggaacggtcgcgcagggaaagttgttcttctctgctccacacttcaccaaaaagcacatcatcattcaattctgcaaactttggcgcaaactctcccaactgtgttcttcctgctgtctattttactgccataatttaaaacctctctattttagcactgttatattgctcatccgttaccggctcacaccactcattgctgcagttttctcccggacattccaccgcaatatgactgaaccaggaatctgctgccgctccgtgataatgttttacacccggtttaatatataccacatcccccggatgcagaatctgcggttctttgccccactcctgatatacaccctcgccggcggtacagacaaggatctgtccaccacctttgtctgcgtgatgaatatgccagttattccggcatcccggctcaaatgtgacatttgccataaaaaccggacattctttcggatcggtcaacggatgcaaaaaggaatctccgacaaaatactgcgcatatgcatcattcggtgctccgatttcaaaggaatctgcctgttcaaatgctgctctttcttcgtacttcatacttttaaatctcccttattcttttcttagttgtattttaaccgttcttttcttgacgcagaagaatcgatattataatatcgtattaacttataagcaatacatatgaggaggtattttccatatgttcaatcatttactcactgtttttgtctgtgccgctgactgcggaagttttaacaaagcagcggaaaaactttatctgtccgcaccttctgtcatgaaacaggtaaacgcattggaaaaacagctggacatgaaactgtttcaccgcactaaccagggactgcatctgacccccgccggtcaggtgatctaccgccatgccaaataccttttttcttattcccggaatgccatcgcggaagcccgtgccgctgccagcctttctgaaaaaacgttttgtatcggaagttcgcttctcaatccgtgcaaaccttttatggatctgtggtacaaagtaaatgcttcgtttccgggttaccggctgcacattgttccttttgaggacgaccatcagggcattcttaccgaaatttcctccctgggcaaaaaatttgattttctcatcggagtctgtgactctgcgctctggctggaccgctgtaactttctgcctctcggcacttatcagcactgcatttctatgtcgcgtgaacaccggctggcgtcaaaaaaacgcctgcgcatcgaagatctctatggagaaacacttatgatggtaaaacagggcgattccgataccgtcgatgcgatccgagccgagattttgaagcatccacagattcacattgcagatgctccgcagttttacgatattgaggtatttaaccagtgtgaacagtcccagaacctcatggtcacaattgaatgctggaaagatgtccatccggctcttgtaacactccctgttgactgggatcacccgatctcttacggaattctctatgccaaagaaccggatgccgatgtaacacacttcattgaaaccgtgaaaaaagcacaggaaaaaaacatgtgaccaaattcccccaaaatttcaaaaacgggaaaatttcatacaaattttattgattttattgggtaattatgtataatactaaattagggaaaaaggaattttttcttactatactataaagaaagaggtttaaatcaagatggcagaaatcaatttaagcaagtatggtatcaccggtaccacagaaatcgttcacaacccttcttatgagaaattattcgaagaagagacaaaagctggccttgaaggatatgaagttggtcaggagacagagcttggtgcagttaacgtaatgactggtatctacaccggacgttctccaaaagacaaatatatcgttatggacaagaactcaaaggacactgtatggtggacatctgatgagtacaagaacgacaaccacccaatgacagaagacacatgggcagttgttaaggatattgcaaagaaagagctctgcgataagaagcttttcgttgtagatgcattctgtggtgcaaacaaagacacccgtatggctatccgtttcatcgtagaggtagcttggcaggcacatttcgtaacaaacatgttcatcaagccttccgctgaagaacttgagaatttcgagcctgatttcgtagtatacaatgcttctaaggctaaagttgcaaactacaaagagttaggattaaactctgagacatgtgtagctttcaacatcacaagcaaagagcaggttatcatcaatacatggtacggcggagaaatgaagaaaggtatgttctctatgatgaactacttccttccactcaagggtatggcttctatgcactgctccgcaaacacagatttagatggcaagaatacagcaatcttcttcggtctgtctggaacaggaaagactacactttctacagatcctaagcgtctcctgatcggtgatgatgagcacggctgggatgacaacggcgttttcaacttcgaaggtggatgctatgctaaggttatcaacctggataaggattctgagccagatatctacaacgcaatcagaagagatgctcttcttgagaacgtaactgtagatgcaaacggcaagatcgatttcgcagacaagagcgttaccgagaacactcgtgtttcttacccaatcgatcatatcaagaatatcgtacgtccaatctcttctgctccagcagcaaagaacgtaatcttcctgtcagcagatgctttcggagtacttcctccagtatctattctgactccagagcagacacagtactacttcctttccggatttactgcaaagcttgctggtacagagcgtggaattactgagcctacacctacattctctgcttgcttcggacaggcattccttgagttacatcctacaaagtatgctgaggaactcgttaagaagatgcagaagagcggcgctaaggcttacctcgtaaataccggatggaacggaaccggaaagcgtatctctatcaaagatacccgtggaatcatcgatgcaatcttaaacggagatatcaacaacgtttctactaagaagattccttacttcgatttcgaagtaccaaccgaattaaacggtgtagatacaggaattcttgatcctcgtgatacttatgctgatgcttctgagtgggagacaaaggctaaggatcttgcagcaagattcatcaagaacttctccaagtatgaaggaaatgcagctggtaaggcattggtttctgctggtcctcagttataatttccctgtatcaggtaaattcgatatgcaaaaagagcatcccatgtggatgctctttttattgtttaccaaaactcaatgctgtaaattctgttaaaaatctaatttaaggcgtcagccccgctctctctggtacggatctttgtagcagtacggatctcatagctgaaaatctttccatccccgacttctccggtaaatgcagccttctgaatggcatcaatggtcgctttctcccattcctcggacgataccacaatctcaaacttaatcttcggctgcatcataacatctacttctgtaccacgcactctctttttatatcccctctgtgcaccgcatcccatcacttgtgatacggtgataccattcacatcaatcgcgtttaatgcttcctttacatcctcaaaaacttcttcccggacgattgcttccacttttatcatcataagcttcttttttctccttatacatgattattttatactaccagatttatctctgtctcgaaataactgacggatccattataacatacgaggtctgtttctgggacttatgaatccagaccattaaatgtcggatacgcactctctccatgctgcgaaatatccagaccaactttttctgctttttcatctacacgaagctccgtaaacaatcttacaatgccaaggcagaccagtgtaccgacaatcgccacggcaactgtcacaacaattccaataatctgtgcaacaaataaacggtaatttccaaaaaacagtccatcccagcgggcgaccggattgatagaatgttttgcaaacaatccggttgcaattcctccccagacccctccgatgccatggcagccaaatgcatcgagtgcatcatcaatctttaattttcctttcaacagggaaatggtaccacagcagatcgggctgaccagtgctccgatgataattgccgaccagatcggaacaaatccagctcccggtgtaattgcaaccagtccaacaaccagaccggtagaggcacctactaaggtaggctttccatccttgatcacatcaataaacatccaggacatcatggcgcttgcactggcaagtgcagttgtcataaatgcatgtgctgccagtccgtttgctgccaatgcacttcctgcgttaaatccaaaccatccaaaccataaaataaatgctccgagtgctacaaacggaatgttatgtacccggtatgccgtctgttcatatcctcttcgcctgccaaggataatggaaaataccaatgcactgacaccggaactgatatgtaccacatttcctccggcaaaatcaaccgatccgatctctgcaagaaatcctccctgtccccataccatgtgcgccattgggtagtatacaatgacggaccagaacataataaataaaaacaatgccttaaattttacacgacccacaagagaacccgtgatcaaagccggcgtaatcattgcaaacatcatctgaaatgcaatataaaccagatgcggtatcgtcgacgcatatggacctgcttcattcattttaattccatgcaagccaaaccaccggaaatctccaataattcctgcatgatttccaccaaaagacagtgaatatccaaacaatacccacatgacaaccgacaatcccataatcgctgcgcatgccatcatggtgctgacgacattctttcttcgcaccagtcctccatagaaaaaggctaatccaggtgtcataaaaaacaccagtgctgaacatatcagcataaatcccgtatcccctgcgttcatcctatcttcctccgatctcttatatttttaaacgcaaaaaaggtgtcaaaagaattctcttttgacaccttcgtcgtagataatcatagcagacttattactccaatgcaagcatttttccataatatttgctattttttatggtacgaactacttctttcgtaccatttttccgtcatttcataaaatcttcaatcttttgattcaattacaataagttgtccggaagataaagaaattgacgcttcatctgaaacaatttcattgctgattccgagagaattaaatcctcccatcgtataatccgtaagcggatactttaatccacgcagggtaacaccacttactttttcagaaaatggaatcaaagaaacatactttccatactgctccgctttccggatcgtcaacggctgattaatcatgcggatacgattatgttcatcgaccaggctgatctttatctgttcctccagaccaataccaagcagactgatattgcccagtacatgatcaattctggtaccggttgcaccaatgaccacaatctccattgcacctctgcgaatggcctcccggatcgcatattccgtgtcggtatcatccttttccggattcagcatgcacacctcgatctgctctttgtcatgaaaatattcaagggtatccggatttaccgaatcaaaatcccccactatgatatccggcagaatatgatcccgatacaatgcttccattcccgcatctgccgctaatatgacatcaaatcctccattttttacaatccaggttaaaaaaccttccttcacttctcccccggaaacaattaaatacttcatcttctacccctgcctttgcaacttttccagaaatgcttccacattcttttcgatctctcccttgaaaaccgcagaacctgccacaattatgttggctcctgcatccatggcttcttccacattttccagattaattcccccatctacttcaatatcggtcttacatccggactgcttcacaagatttttcgcttcacgcactttatctaacgtatacggaatcagtttctgtcctccgaatcccggattaacggtcatgataagaagcatgtccaccttcggaagaatatatcggacagtttccagcggagtggccggatttaatgccacaccggccagaactcccttttccctgattgcctccactgtgcggtcaagatgcctgcatgcttctgcatggaccgtaataatatccgctcccgcgtcaacaaaatcatctatatagcgaatcggttcctcaatcatcagatggacatcaaatatccgatcggtacatttacgaatggaacgaatgatcggaaatgcaaacgaaatactcggaacaaacattccatccataacatcgatgtgtacatattccgcacctgcctgatccagcaaccgaatctgttctcccagattagcaaaatctgccgataaaattgacggtgataaacagttcattgattcctcctaatacttgcgcatgttcttcatttcctgataaagctgcacgtaattgtcatacctcacctgcgatatttttccttctgcaagtgccgtcttaacgccacaatccggctctccgatgtgactgcatccgataaatctgcatccaggctcaaaacgcacgaactccggataacatgtccacagatcctctttggaaaatccgggcagatccatagaactaaaccccggagtatccataatataggtgttttccgcaattggtataatctgcgaatggcgtgtcgtatgttttccccgctcaatcttgtcactgattcctccggtctgcatctgcaccgcatcctgcagatcattgatcagcgaagattttcctactccggacggtcctgccactgccgtcatctttccctgcaacacagatttgagtttttccacattttcctgtgtctttgcacttgtaaagagcagctcataccccgccagttcataaatttttcgtaatacttctctttgttcttccgtcaccagatcgcatttgttaaaacagatcgtaaccggaactttctgatattccatcatacacaaaaagcgatccagcagattaaaattcgggtccggttttgcagccgcgaaaattacgagtgccatatcgatatttgccactgcggggcggatcagttccctggtacgtggaagaattttttctacatttccaatctttttttcttcatccagtacaacgatttccacatcatcacccacgagaggtttgatcttctgattacggaaaattccttttgccttacattcataaattccggtttctgccacgtgaacgtagtagaaaccggaaattccttttacaatctttcccttcatatattacctactgttttgaaaagctgacagaatgtgtttctgtctttgtagacgtatcggaaagaccttcatcatctattgtttcaatgctccaggtaatcgtcactttaccggactcacatgccatatcggatgccccgatcgtaagagaaccatcgacatcactgtttccgcttgcataggtcgtgccatcacttcccgtcagtgtatacgttgcactgactgctccttccggtgctgcatatgactttgagaatttatagctgtaatttatctcttccggtcccttgcttaccgtaatcgttaccgttgtatctgccggtacaatcttgccggatgctacactctgtgaaattacctgacctgctttgacagaatcactgtattcttctttcactgcaacttttaagccagccttctgcaaagccgcctgtgcatctttcttggagtgaccctgaacagatggcaccgtactagacttctttccctgactgatcacaatcgtaaccgtacttccctcctgtgcatttccgcctctcgggctctgggaaacaacctttcctgcatctacggaatcatcatatttgtatgttttggacactttaaatccggcagccgaaagggtagaagaagcatctttttccagttttccaactacatttggaaccggaacatcgttctgctcactctgactctccgaatctgtgaaatccacattttctgttccggcaacaattacattgattgtcgttccggcagatacttcagaaccaccaaccgggtcctgattcagaacggttccttccggctgatccgacttctgctcctgaataacaaacatatacagcccctgtgcttccagttcagactgtgcctcctcctgtaactttccgcatacattctgtaccatgacaggctgttcactttctgtctgtgtctgtgtctgcgtctgtgtctgcgtctgcgtttctgtattctttgatgaattactgccaaaacggaataagccaaagaaacttcccacaaggtaaataatcactgcaaggattacaacaaacaccacaattcccatgatggtcattgccttatccatcttcggactgagtccttcgttttcgtcctcatcctcatcgtcctcatcctcatccggatcataggaagattccagcttggaagcgtgcctgtcttcttttggctcccccccgtgttctttgatctgctttaattcttccccactgatgaccttggtctttccattgtccacaagcggagcaatcacaacaaaatcctcatccggatgtaccagcgatctgcgcaggtccgccagcagatctccaatggtctggtaacggcggtccgcattcttctgtgtacattttaagataatcttctccatgctgatcggcagattctttgcatacacacttggaggtgtcatctcttcctgcagatgctgaatagcgactgcaaccgttgtatctccgtcaaaaggtacacgtccggttaccatttcatacataacaatacccagagaatagatatcgcttcttccgtctacaaacccgtttctcgcctgctccggagaagaataatgaaccgatcccatcacatccgagctgacggtattggaagatgcggctctggcaataccaaagtccatgaccttgacttttccctctgtggagatcatgatattctgcggtttgatatcccgatggatgatctgtttgttgtgggcagcttcaatacctcttgctacctgaatggcaatactgacggcttccttaaaggataactgtcctttcttttcaatgtatgtcttaagtgtgattccctcaacatattccatgacgatataatgaagcccctcttcgcttcctacatcatagatatttacaatatttggatgctccagccctgctgctgactgtgcctccgtgcgaaattttgctacaaatccacgatcttccgaaaattccggttttaatacttttattgccacaaaacggccaagcacatgatcctttgctttataaacatcggacattccgcctgcaccaatcttacttacgatttcatagcgatctgctaaatacgtcccaactgttaacattctttcacctcatcaagaaaatggttctataatcattactgtaatattgtcttttccaccgttgtcatttgcagtttttacaagaagtccggcgcgttcctcaatggaagcatcccgcagaataatactgcagatttcttcgtcttccaccatattcgtgagtccgtccgtacagattaagatgtggtcatctttctttaattccacttcaaaaaaatctgcctctacttcttcccctgcaccgactgcgcgggtgataatatttttgtccgggtgctcacgtgcttcctttgcacctacttcaccgatcctgaccatctctgccacaagagaatgatccctcgtgatctgccggatgccatccgtaccgatgatatacagtctgctgtctccgacatttgcaacataaagccgtccgtcaataatggtggctgcaacaagtgtcgtccccataccttttttcgcttcatcttctgcagcttctgtgatcagaagtctgtttgcagttgttattgcctcttttaaaattgtaactggttcttctcccgaactccgggacacggatgcaacgatgcgctgcgttgtgtaacgcgatgcgtaatctcctgccttgtgtccccccatgccatctgcaacaatgtacagattcgggagattcccaacgggttcatccgacgcgaaaaaataatcctgattcatttcacgaagaatgcctgtatccgttatggaatacgtcttcatccgctttatcctttctcaattacatgtaatatacatactcttccatcatctgtctatcttagcacatgacttttcgttatgcaagtctctgattctctttgtacttgcgccttaattgtccgcaggcaccatcaatatcacgccccatctcacggcgtactgtcaccgttaaaccactccgttccagtttctccttaaaagcttcgatgacatgtgcatttgactgcacataatcccgctccctgatcggattcaccggaatcagatttacatgacagttcatcccgtggatcagttccgtcagttcttttgcatcttcttttgtatcattgacaccacctaccagactgtactcaaacgtcacacgtctgccggtctgttcaaaataatacctgcaggcatcaattacttcatgaatgtcatatttgttcgccaccggcatcagctccagacgttttttctggttggaagcatgtaaagataatgccagcgtaatcgcaagttttttatccgccagttcccgcatccgcggaacaattccgcaggtggaaacagtcaggtttctctggctgatgtgaagtccgttctcatccgtcagcaaagtgataaattttaccagattatcaaaattatccatcggttccccggtgcccatgacaacaacattcgaaatccgctctccgatatccttaccaatctgatagatctgatccagcatttccgccggtgcaagtcctctcaccagtccgtccagtgttgatgcacagaaccggcatcccatccgacagccgacctgtgaagaaatacatacggaatttccgtgcttatatttcatcagcacactctcaatgacatttccgtcttccagtaaaaacagatatttgcgggttccatccagttttgaaatctgtacctgttcttttctgagtgtgatgatcctgcaggtctcatccagtctctcccgcaaggttttggaaagattcgtcatctcctcaaagctttccacctgccgcacatgcaaccactcatatacctgctttgcacgaaacgctttctcccccatatcggaaaaaaaggtttttaattcttccagatccatggacttaatatctgtcttttcactcatcctcttatttactccttaccagctttgcaagaaaaaatccgtcacttccggcttctcccgggaaaatctgtctctggaattccagggaaaattccggatgttcttttaaaaaccatgcggtgttatcctcattttctgaccggtggatcgtacaggtactgtacacaagtgtcccgcccggtctgacataatcccatacaacagaaagaatctgtctttgcagttttgcaagctctgccgccttttctttggtcatcttataacggatatccgtcttctttcccataacgccaagtccggaacacggcagatcacagactaagacgtccgctttctgatgggaatccggatcatccaccgttgcatccatctgtaccgctttcatatttgacaatccatgtctggctatgttctcccggatcagatccaccttatattctgtcagatcccttgcctctaccataccacttccctgaagcagttctgccatatgggtactctttcctcccggtgccgcacacacatcaatcacataatcattctttttcggtgccgcagtttccgcaaccagcatggagctgacatcctgtacataaaacagcccttctttaaaacttttcagtcccgccagataatccagcccggatatttcaaaagcatacggcagttccggaaccgcatgtactgtcaccccttctgatttaagtttgtttacgagttcttccggtgtcacagcggaaagattggtacggatcgtcagccggttttctgcggtaagtccctccagaatctgacgggtcttttcctctccataattttcggtccatatgtccacgatccattccggcatcgaatatgtaacgctcagattcgggaagcgaacttctctccatcctcttgccacactacgcagcacaccgttgacaaatccgctcaggccagaaaacccacgctttctcgcaagctttaccgcctcgttgcacactgcggaatccggcacactgtccatatacataatctgataaacgctcatgcgcataagattgcggatgagcggtttcattttctttactctggttttggaaaactgatcgatcacatagtccagtgtcagctgtctttccagcgttccttccatcaggcgcgtcagaaaagcgcgttcctgttttcccagatactgatatttatcgagcacatcgcggaggaccagatgactgtactgtccctcctcattgaccgccagaagcatttccagcaccagtgctctctcattgaccttagtcgtcacgacttcttcctccaaacagtaaaacgattcgaagcagctgcagaatcgcagctgctgcacttgccacatacgtgagtgctgctgctgtaagaacttttcttgtgtaatggagttcctgatctcccaggattccctgttccctcagctgaaccatcgcacgacgcgaagcatcaaactcaaccggaagcgtaatcagctggaataacacagcaaacgaaaacagcagaattccgatattgataagcatcatggaggaacggctgtttatgatcacaccaagaatgatcaccggccatgcaagcatggaaccaaagtttgcaatcggcacaaatgcggtacgcagccgaagcggcacatatcctctggcatgctggatcgcatgtccgcattcatgtgctgccacccccacagctgcaaccgaagtctgattgcagacactgtcggaaagattgagtgtcttattggcaggattgtaatgatcggtcagatttcccgatacatgctgcacccgcacatcatagattcctgctgcgtgcaaaatccgctctgccgcctgtgctcccgtcattcctgacatactgcggtatgcggaatatttgttgaacgttgtctttacccgtgcagatgcaatcatacagatcactgcaccgataacaaccaatatataggtactgtcccaataaatgtatggcataaatctacctccgtcttactgctgtaaaaaagatccctctgcaaccggatagccacgcagaaatgatcctgcatccatccgtttcttaccggcaagctgtacttccaaaagttccagtccaccctctccggtctgtaccaccatcgtattttttccaactttacagatacaacccggtgcataagcgccatctgtctccaccacccgggctttccagatcttaaacgctttattatccagatgggtataggcactcggccatggatttaatccacggatcaggcgctcaatctccaccgccggctttttccagtcaatatctcccagctccttggaaatcatctttgtgtgggtactcgcctcattgtcctgcggtgtaaaggtcgccgttttgttttccagcatctgcatggtttccacacacagctcggcgccgactgccgccagcttgtcaaacagacttccacctgtctcatcttctgcaatgcgcacctgttttttggcaatgatatctccggtatccagtccgacatccatgcgcatagtcgtaactcccgtgatctcatctccattgatgaccgcccactggatcggtgcggcaccacgatatttcggaagcagggatgcatgtacattaatgcatccatatttcggaagatcgagaatactctttggaagaatctgcccgaaagccgccactatgatgatatccggcgcaaactttttcaaatattccacacttgcatcttcccggatttttaccggctggaatacttccagtccatgggaaaccgcacattcctttaccggtggaaactgcatggtattcccgcgtccctttggtttgtccggctgtgtaaccacaagcataacctcgtgtccggcttctatgatcttttccaatgtattcaccgcaaaatccggtgttcccataaaaattactttcatattattcctcttccggctcctcataattcacatcatgaagtccgccttctactttttctgtatacatatgtccatccagatgatccagttcatggcaaatgcagcgtgccatcagaccttcgccttctacttcccactcattcatgtccagatcataaaattttgcttttacatggttcggacgtgtaacctgacctgcttttcccggaagacttaagcatccttcatctccggtctgctctccgtcagactcgataatttccgggttgatcataataaacggtccctgtccgtccccgatatcaatgactaccatacgctttaaaattccaacctgcggtgccgcaagacctacaccgtttgcctcatacatggtctccagcatatcttccgccagagtacggatgcgatccgtcacctccggaatcggtctgcatacttttgtcaatacgggatctccctgaattcgaattgttctaagtgccataattacctcctaaaaaccacttgttgggttaaaatcaaactgtacagacacattggaaaatgtgctgttattttttatttttcgttccaccagatccttacatgccaccagcgtcgcatattccggtgccttcatgtaaatgacctttcggtaaacatcactgatttttgcaatggatgcatctgccggtcctaccagcataatatttttgcctttctgtgatatcacgcgatgcagaaattctgccagatccctggctgcagctgtcgtcacctgcggatcggttcccgtacaatgaatcagaagcagctgccacaccggcggataggcaagcattctccgataggcaatctcctgcttataaaatgcatcgtaatcctgttcctttgcggtctgaattgcaaaatgatccggatcatacgtctggattaccgcctgtcccggttcctttccccgcccggcacgtcccaccgcctgggtcagcagctgaaacgtccgctccgatgcatgaaaatccggaacatgcagagacatatctgcggcaagtactcctaccagcgtcacattcggaaaatcatgccctttgacaatcatctgtgtgccgatcaggatatctgcctcctgattggcaaatgcatgcagaatcttctcataagcatccttggtccgtgtggtatcaaaatccatacgcatcacacgtgcctgtggaaatctctgttgcaccagcatctcaatcttctgcgtgcccgccttgaatccgcctaaatatttactgccgcaggatggacagatctttggcaatggctgctcatatccgcaataatgacagaccatccggcctcccgcatgctggctcagcgaaacatcacaatgaggacattgtatcacatatccgcaggctctgcatgaaataaatccggaaattcctctccgatttaaaaacagcatgatctgctgacgtttttttaaccggtcttccatcagttcctgcaatctctccgaaaggatggaacggtttcctgcccgcaattcactgcgcagatctacgacctcgcaatccggcagcggtttcttctccacacgctcagacaacgtcagaagctgatattttccctgcattgcctgataataactgtccactgaaggagtggcagaaccaagaagtaccgatgcatcattcatgcgcgctctctcgattgcaacatccctggcatgataccgcggtgccgtctcacttttataagacgtttcatgttcctcatctataataataagccctaaatgcggaaatggtgtgaacaacgcagacctgggtccgatcataatatcaatatcccccgccttggcacgttcaaactgatcaaagcgctctccctgggaaagtttggaattcataatggatacccggtccccaaaccggttataaaaccgcatcacggtctgataggtgagtgcaatctccgggatcaggacaattgcctgccgtccctgtgccaccgtatgcgcaatcagttccatataaacttctgtttttccgcttccggttactcccctgagcagatacgttttatgaattccagcatccagatccgaacatactgtgtccacaacacgctgctgattttcattcagtgtcagatgatatcccttctgatccagatgtgacacaggattgcgaaactgtctgctgctctccaccttaagaatctgctgctgtgccataccccggatcactgctgctgatatattcagttttccggtgacaagcgaataatccagtacggattcctgtatcagttcccgcagcagccttgctttcgccgtatagtgtttctgttcaaagagtgccagtttctgctgcgcctctgtcttcggaatcagtaatacaacctcccgcttctgtacttctttcgtctgcctgcggatcgggagtacggtctttagtgcctggttcatggtggaaccgtaattcttccgcatccatccggccagtgcaatgagctgggattccattgccacgcttccctcatgtaccgaaataatggggcgaatccgtctgggatcaaattcggcatcctccgtcagttcaatgacataccctgtcagtttacgatttccaaatggaatatccacctgtacaccaacctgtatttcctcctgcagattttccgggatgctgtattgaaaagttttatccagtttttctaccgatatatctacaataatatttgcatacttcatacttattcttttctcaaaacacagttgaccaggccctcataggtatttacagcagcctcaatcaccggagaaacgccaagttctcccagtgctgcactgcatttcggcccgatcgaataaatatccgtaacggatgccagtgtttctctctcctgtggctttaaactgcccagcatccgctccgccgaagacgcacaggtaaaaaagatcgcatcgtatacatccttgtccactggcacctccatcggacaaggtacattttcgtatacattgagccgtccgcaatcacagaaagaaagcagtgtatccacaaggttatcctttgcattttttgcggtaggataccagattactgcccgcttaaacggatctccgcgaaattcctgatccagatattcctttaattcctgtgccagattcgtactgttggaatgttccggcataaagtctgcacaaattccatactcccgcagtttttctgccgtcttttgtccaatcactgcacatctggtatggaaaagtgcccgtgcatccagccccgatgcaaatacatttttcataaaataatccacaccattggcacttgtaaacaataatacgtccacatgcgccagttcctgtgcggtatacactgccggcacaccgacaatctcacctgtcatacactcactggtatacgccccctttgcccgaagcatggcggccagacgtgaaggttttggaccaatttttgcaaccagataatgtttcccccacagcggcttctcttcaaaaaaatgcagctggcggcgaagtgcaaccacatccccaacaatgatcagtgccggagaggtcagtttcgcctcttccacacgatctgccagattctccagcgtaccctcacaaatctcctgcgcttctgtcgtagcatgggaaatcacagctgccggtgtctgccggcttcttcctgcctgcatcagtccatccacaatctgtcttactctcgaaagtcccatgagaaaaatcagagtttcttttgaatctgacatcgttgtaaaatcaggttctgacagatcctctccgtttttttggtgtccggtgatcacccgaaagcttgtggcaacaccacggtgtgtgaccggaattcctgcataagcaggtcctgcaatggcagaagtcacccccggaacaacggtataggagattccatgttcccgcagataaaggccttcttctcctccacgcccgaaaacaaagacatctcccccttttaaacgaacaacgcaatgatattcttttgccttctcgaccagcagttcattgatctgttcctgcggaagcgtatgatgccggtccgcttttcctacataaatacgctcacagtccattcctgcataccccaataattccggagacgaaagtctgtcataaataatacagtctgctttttttatcaattccagtcccttgactgtgacaagtcccggatctcccggacctgcaccgaccagatataccatagatgccattcttttttcctttccctgtcagcactgctgctttttaataaatgctgaaaattcattttccggcattggttttgcaaataaaaatctatcttattataccacttctgcggtattgcccgcaaccgaacccctatcgggtacacccggtttcccgcaatgcacgctgtgccgcttcctgcggtgtctctccgaaaaccttacatttctttatactgcttccatccgcacttccgaccattccaagcaattgcatccttccatcgggcaatttgcaggcatatgctccgatcggcatatggcagtccccaccggttcccttcaaaaacagccgctcggcacatgtaatctcctccgtcacgatatctgaaagtgcattcacctgctcgaacaattctttgtggtcttcccgcaattccagtgccagcgtcccctgtgccgctgccggtatcatctgttccggctcaaaatactgtgtgatcaaagaagttctccccagccggtgcagtcccgccgccgcgagtacaattccgtccagttgttcttcctgcatcttttttattctggtatcgacatttccgcgtattcccgtaatgcgcagatcctttcgaagctgcagaagctgaaatgcccttcttcggcttccggtgccgatcacagcatgctgtggaagttcctccagtgaaacggcttcccgcaaaatcaatacatccctcggatcttcccgtttccatgcatgtgcaaacacaagtccggacggctgttcggccggcatatctttcatactgtgtactgcaaggctgatcgttccatccagcagttcctgttcaatttcccgcacaaaaagtcctttatccccaatctggtctaacgcttttttctgttcccggtcgccttttgtggatataattttcagttcgtaactgttttgtggataatgtttctgcaggcggttttttacatactctgcctgcgccaatgccagttttgatcctctcgttccaatgatcacattcattctttttctccctactcccggatttcggtatcaaactgaaataaatcctgcaatacctttttatactgttcctgctgctctttggattccgtctgtttaagctccaagatcggctcccggatcagacgctttaatgatgcctttaaaatcttttttacaattttctgatccctcgtactcagatccagtttgcggtttagatatgcataactgtcctctacaatttccgtacagcgctgctgcaacgaagcgatcgtctcatcgacaccggtcgttgccagccattccctggtttccccaatggcttcctctatcatacgctgacctttttgcaccagttcttcccgctgcttccggttcgtctctacaatttcatttaaactgtcaagattaatcagaagtgcctggggatttcgtccaatcgccgtctccacatcccgcggagatgccaggtccaaaattgcagtcggatgtaacaactgtatgtctttttcccggataatatgatgcggggaggctgtagcggaaactaccagctcacactccttcattgcttcataccgcttttcaaacggaatgatggtaagtgtgggaaactcatgcaggagatttccggcatgtgaaaatgtccggctgcagacggttacatgagaagccccgtattcatacagataacgcagagccagcgttgccgtatgtccgcttcccacaaccagtgcttttttccctgcaattccaaacgtttcctgcagctggcggattcccacatagctgaccgaaagcggccgttcactgattcttaactttgtctttatcttttttgcacaggtgaccgcatcctgtaccacacggtttaactctttcccggtacttccaaccgtccgtgataattcaaatgcatccctgacctgtcctaaaatctggtcctctcccagcaccatggactccagtcccgcagtcacccggaacagataggaaatggcatccatttcctcccgttgtttgagatattccgaaaaatctactcccggaaacatctcttcatacaaggtgcgaatcactccggacggctgtgcaatctcttccggtgcaaaaaaatagacttcgctgcgattgcaggtcgaaagcacaaaacattgttcaattcctgctttcccggctttctgcagaaaatcaattttctgattatcggtaaaggacaccctgtcacggatgtcctgatctgcatgtttataatcaattcctatatatccaaatttcattctgcaaagtactcctgcatcacatggatggtcttttgtatatctgcatcggtatgcgcatcggacacaaacatggattcaaactgtgacggtgccacataaattccatgatcaagcataaacccaaaataatcggcatatgctttggtatccgcggttgtcgcagaatcgtaatctgtcacatcttcgccggtgaagaaaatactcatcagagagccgatctgattgacatgcacacggtttcctgcggcatggcgcaccgcatccgccagcatcgctgtattttcctgcagccgcatataaatatccgtatctgcctccagaatacgaagtgtggcaagccctgcagccgtagcaatcggattgccggaaagtgttcctgcctgataaaccggaccgtccggggaaaccatacgcatgatatcctctcttccaccatacgcgccgaccggcatacctccaccgataatctttccaaacgtggacaaatccggcgtaatatgaaaatactcctgtgctccgcccagtgccagacgaaagccggtgatgacctcgtcaaagatgaaaagtgccccgtaatgttttgtgatctcacgcaaaaactccaggaatccgtctgccggcggaacaacgcccatatttgcagccaccggttccacgatgattgctgcgatctcatccggataagcctcaaacagtgccttgacgctgtccggggaattgtattctgcaaccagtgtatgtctggtaaaatctgccggaacacccgcactgtccggaacagatgttgtcaatgccgcagatcctgcttttaccagaagtccgtccgaatgaccgtgataacatccacggaatttgatgatcttgtcacgcttcgtatatccccgcgcaacacggatggcactcatcgttgcctctgttccggagcttaccagacggctgacttccatggatggcaccagctgtgccagaagttctgccatctccacttcccgctctgtcggggcgccaaacgtaagaccttcctcacatgcagcctttaccttttcgatgacacgtggatcggcatgccccagaatcccgggtccccaggaacatacatagtcgatcatttcatttccatccacatcggtaatatgggaaccttttgcactctgaataaaacgcggcgtacgccctacagcctggtacgcacgtaccgggctgttcacgcctcccggaagccggagttttgctctcatataaagtaattctgatgtctggtctgtcatgttatacttctcccttctgtatccattctgccacatcgagtgcatgataggtaatgatcatgtctgctcctgcacgtttcatcccgatcagattttccatcacgatctttttctcatcgatccatccgtttgccgccgctgcttttaccatggaatattccccgctcacgttataggcaacgatcggaatattataatttctgcggatctccgtaatgatatccatatatgccattgccggtttggcgataatcagatctgctccctctgcaatatcctcttccacttcccgcatggcttcacgcccgtttgcagggtccatctgataagttttccggtccccgaaccctggtgccgaatgtgccgcatcacgaaacggtccgtaatatccggatgcaaattttgcggaatatgccataatcggtgtataggtaaatccggccgcatcaagtgcctgacggatcgcccctacacgcttgtccatcatatcgctcggcgcaatgatatctgcccccgcacgcgcatagctgaccgccgtctgtgccagaagcggcagtgtctcatcatttaaaataattccatctctgatcaggccacaatgtccatgcgaagtatactcacagagacatacatctgctatcacaagcagatccgggtaatcctttttgatccggcggatcgcggtctgtacaatgccgtgctcatcataagccccgctccccacttcatccttatgttccggaattccaaaaatcagaattgccggaatctgcaatgctttcacacggtctaactcttcgttcatgcggtcaacggaatactggcagatgcccggcatggattccaccggctgtacgatattttccccttccataacaaaaagcgggtagatcagttcctctgtcctcacgtgattttccctgaccatacttcgcataacagcagtctgtcttaatcttcttgttcgatccattcccttgttcctcttttcttttactctttcatacgcttttcctgtataagaatctgttccagttcttccggtaacagtgaagtttttttctctgcaagcagcctggcaagaatggtctgatatacctgtctgcgcagtttttctgtttctatccgcgtttttaccaccggacggatacttcccatataatcgttaatctgtcccagttcttccgtcagaatttctttcagagattcttttaaatactgtgtgagcaccggactgtttcccgcactggaaaaagcccccaccagatcccggtgtttcagataggacggaaaaataaaactgcagtcctcctgctgatccacggcattgaccggaatatgctttttttgtgccatccgggcaatcctgtgattttctgtgacatcatcagtagctgccacaaccagaacacattccttcagatcctccggttcaaaggtacgttcctttacacatacatttcctgtaagctgcagaatctgcgggtcaatctgtggtgccaccaccgtaatctgcgccccgaaatccagaagcacccggactttgcgcaatgccacagttcctccgcctgccactaaacatttctttttttcgatatctataaacattggaaaataagccataatacccttatcttataattgttttgtatttttttcaagtatatctgctggataatcgcatatcctacatgcatagtattttttgcgggaggtcttttcatgaactggaaaacattttttatctgtggtctgaccggatggtgcatggaaatcctgttcacctcgctgggcggactgctgcggggagatctgcttttaaacggacacacatccatctggatgtttccgatctacggacttgcagcagtcatcggacctctttccgtgcgcctgcgccactggcctgtgcttctgcgcggctgtttttacggtgccggcatcatgctcgttgaatttatcagtggcagttttcttaggcttttctctctatgtccctgggattacagcaaaaccccctacaatatttccggtcttgtccgcctcgattattttcctgtatggttcaccgccgggctgatctttgaatatattctttcccaaaaaaagaagcacatcctctcgtgatgtgccccttttcttacattacttttatctgacgccggttcggattggtatatttttcctcgcaatacttgcagcggtacacttctttttcctcatctgccagaataaagatctgatccagttcctgctcgatcgatgtcacgcaacgcggatttttgcacttgatgacatttttgacctgcttcggaagcttcagttcctttttctctacgatccggtcacccttaatcacgtttaccgtaatattatgatcgataaaaccgagaatatccagatccagcgcttcaatcggacattccactttgataatatctttcttgcccattttattactttttgcattcttgataatggcaacggaacaatccagcttgtccagcttcagatcatgataaatctgaagactcattcccgcctggatatgatccagtacaaagccctcgtgaattccactaatattcagcatctttactccacctcgattcccagtaatgtcaggatcagtgccatacggacgtatacaccattctgtacctgtgtaaaataagccgcacgcggatcatcatccacttcaacggaaatttcattgacacgaggcagtggatgcagcacgatcatgtcatccttcgcaagttccatcttttctttggtcagaatgtagaaatctttcagacggatataatcttcttcgttgaagaaacgttctttctgtactcttgtcatataaagaacatccagctggctcatggcatcttctaaacgctccacttcctcaaactccacatgatttgcctgaagtacatcctcccggatgtaatccggaatctttaactcttccggggaaatcaggataaatttcacgttttcataacggatcagtgcattgatcagggaatgaacggttcgtccgaatttcagatccccgcacagaccaatcgtaatattccccagtcttcctttcagggaacgaatggtcataagatcagttaatgtctgggttggatgctgatgtccaccgtcgcctgcattgattacagggatacgggacttctgggatgcaacgagtgccgcgccttctttcggatgccgcattgcacagatatctgcataacaggaaataactcgaatcgtatcagaaatgctctcgcctttggatgccgatgaagaatcagcactcgcgaaacctaaaacagaaccaccgaggtttaacatggcagcttcgaaacttaatcgtgttcttgtgctcggttcataaaaacaggttgccaattttttgccatcacaggcatgtgcatatttctttggatgcttctcaatgtcgctcgccagatccaacaactgatccagttcctctacggagaagtctaaaggactcattaaatgccgcatttttatcctccttcagcttaacgcatttttactatcatataataaactgcggctattttcaaggctaatatagcagctatataaaattaacatgggcgacagcaaaaacacaatgcctgcgcacacagcagactcatgcagaaattgctgtaatttccataaggacgctcatactcgctccccatattggtataccaggttccgccatattcaagatgctgctggaactgccggtactccatattgctcggctcaagttccaccgcacggcggatatgctcaatcgccgttgcactgtttcccacgccttcatttgccaccgcactgtaatagtaccactgtccggcacgctcggaaaatggaatcgaacttaacacattgagtgcttccggataacactgattctgaatataattaagtgccgcctgtaattttggagaagtcgcacggctctgggaacggtaggttccatttccataataatactgtccgctgaaccctccaaacggcccctgtccatagcttcctgtgcctgccgatctgccatctgcagagcctgcaccataactgtagcttccagaagttccctgctgtttttccttcataatcagatcataggcctgctgcacctgtttgaaacgttcttccgcctgatctttgttcgggttgttgacatttgcatctggatgatacttccggctcaatgtacggtatgctttctttatctcttcatccgaagcgctgcggctgacgccgagcacctgatatggatctgtcatgatttcttcctctttttcttcaactgaatgtattcatacttggaccatacaccggaatacagaatattccgcagaatatccgcgtgaagcagaatcggcaggcgttcaaaagacttcgcgcattccgaaatcatgctggtcatcatcagacggcacaacgtctcatactcctgctcatcttctgtatccagataccggagcgggttgtaactgtcttttttttcatctttatcccggtcctcgtaggcatccatcaggtagataaatttgcccagataaaatccaagtgttttcaattcatcataccactcgtcctgcttccatgcaaatatttctccgagcatctcgcctgtcagccctgccacaagatcaatattcgtctgtttttccgcctcataagctgccagtttctccatatactgctcaatggcattggtctgccgcggataatttattttgatccgctgataatctttctcaaacattgaggcaatggttttcttcgtgtaattatggtcatctttccagtcatccaccagattgtaatatgccagaagaacgttcatctgtgccgcataactctgaatatcgttttcccgcagctgccgttttttcatcggatgcatcatacaggtaaattcaccagtctgcgtgtccggctcatacagaccggtcagcagaacgaccagaaatgtcatatcataattcaaaagtgcctgtcctttttttccacagaactcttttaatttccggcaaagcccacaataatacgactgatatatttttttattttcttccgacagctgtgcgccgtttacattgatatatccgaacatactgcctccgatttaggttctgcgaataaatttttccctgcatttcgggcaggtaatctctatctttccatgtcccctcggcacacggacttcctgtttacacatcgggcacttgaaaaagcggtaatcccttgcctgtcccatgcgttttttaaaccggttccacgatacggtgcggttataacggaaattcaaatacttctggttttcttcataacgtttggatgtatttcttgaaaatacccggaaatacatataaatcattaaaatcagcgctacaaaggaaaacaggccaatgcgtgtaaacataccgacaagcaaaagaatcagaacaagccaggactgcatccgtgccagttcatccatgccatttcttccctgcataaaacgatacaatttgtctctcatacaattcctcttttctgtgtttcgtcgatatttttcgtgtcttatattagttatatatcatgggaaatcatatcgtcaagcaacgtattttcttttcatacacttttcataaagtgtttagaaatccgggaaatttataatggtatagacgtgaaaaatgaaaatttccaaagaatactgctgatatttacggaaaacatcttaagaagaaggacgataagccgggttatgtcgttgggtgatcatctatctagtacgattgttgccaaccgtctcaagcgacctacctaaagctggcgggccacgtcagcgctttgtttcggtcttgcttcgaatggggtttacatgtgccctctctgttaccagcgaggcggtagtctcttacactgccattccacccttactatagaggtgcatctgtgatgcatctcttatagcggtatatttctgttgcactttccttagagtttcctccaccggccgttaaccggcatcctgccctgtgaagcccggactttcctcacctgcggtctttcgacacctgcagccgcgatcacctgtcctccatcttaagatgcttttccactataacacagtttccagtaaggttcaagccgtaaagtttaccgtgtttttatacattaaaacaacttcctccgacaaattcccgcaccagagaactctgtgcaattccttccgtcggaagcggcagaaaatagtccaaaaacttaagcagacgcttcgcttccagatattctgcactgtcacgcggaatctgaaacagaagcggttccgcatatactttaagcaccgcaacctcatacagtaacgcggaattaaacatgacatccgcactgtcctgaaacgggaaaatatttttttcttctccccttcgcacagatttccacatcgcaatcgtctcctgtgccgtcgttccacgggttctggcatctctcacgatccggcgtaacagacggcagtccgtcgtggacagcggattgtgttcatcaatattcaactgtgtcagcgcagaaatataaatcttaaatttactttctgcgggaagtgtatacgacagcttatcgttcagaccatgaattccctctatgacaagaatatcattttctttaagctgcagggtcctgccacggtattccctctttcccgtcttgaaattgaaagaaggcatatctactttctcccctgccagaagccgggtcatatcttcattaaactgtctgacatccagtgcctccagacattcaaaatcaagatttccgtctgcatccctcggacaccgctccctgtcatcataataatcatccaaactgatcggatgcggttttcttccctttgccagaagctgaatcgacaggcggttggaaaatgtcgtctttccggaagaagacgggcctgcgatcatgacaaatttaattccttttttctctgcaatctgtgctgccagggaaccgatccgttcctccatcagcgcttcctgaagcagaataatctgttcgcccctgccggatgcaattgcatcattgagcgcgccgatcgttccaacgtccagcatacggctccagctgcgtgattcttttaatgtgtggtacagtttattggaggtatgaagcggttccacttcatctccctttttatttgggaacaaaagaacaaatccgtcttcatataactccagatcaaacactccgagatatcccgtggatggaaccatataaccgtaataatagtcctgatgtccgtccagctcataaatattgacacgcgaacttctgcgataatgtaaaagccgctctttgtccttcattcccttatcatgaaacagctgttccgcatcttctgtttttacactgcatttcttgatcggtaaatcggcctctaccagacgctgcatctctgcacgcagtgcctgcacggctgctacatcattagcagttccatgcagttcacagtaataactttctcccagagaataatataccctgatttttacctgatccttccacagattttctaccgccttctgcaataaaagcgtcatacttctgcgataggtgcgtttgccgtccctgtccgtcatcgtcagaaacgaaattttaccgggtgccttcaccacttttgaaagttcccgcagttttccatctacacatgccagtacaatcctgtcactgtaatttttctgatattgttttgcaatctgttccagttttgtctgctccggaatcagaaccagttcggttttctccggcgcagtctccaatgtgatctcaaattcctgcactttttatcgcccccaaaatcgtatacgcagattcattctgctgtaatttttcctgcacttctgcaatacgtcgtatgatctgttccgattctttctgtgcttcaagcgtctgcagaatctgtgtcagctgtccatgctgacgcaccaaaaaccggcgcagtaccggatttccgtttctcagaagaagcggtccgtaaatatcacagactgcaattgtctgatcgttcaaccggttccacgtttcatcctgctccgtttttacggcacgcatcatcggataatattttccttcttcacagaccatatcttcatcttcaattttatactgatgctggcgcagatattcccggaccttatgtatttcagactgtggctgcaaaatcagttctttcgctgtactgcagactaattccccttccgtcagaatatgcagaatcagttctccacccattcctgcaatcagaatggaatccgcttcatttggaagcagtgcctctgccccgtccgaaagcctggtctgtatatattcctccagcctggctgcccggatatgttcctgcgcccgggcaagcggtccctcattaatatccattgcaatggctccctttattttctgcctctgtaccagtgcaatcggcacatacgcatggtctgttccgatatccgcaaggataccgccggttgtaaccatggaagccactgctttcattctcctcgataatttcatcatgttactctaaataatcctttaacttacgacttctgctgggatggcgaagcttacggagcgcttttgcctcaatctgacggattcgttctctggttacattgaactcttttccgacttcctcaagggttctcgcccttccatcctccagaccaaagcgaagcgtcagcactttctgctcccgctcggtcagtgttccgagtacctcttccagctgttccttaagcagcgtaaaagttgcagcatctgccggtaccggtacattatcatctttaataaaatcgcccagatgggaatcttcctcttctccgattggtgtttccaaagataccggttcctgtgaaatctttaagatttcccgcacacgttccaccggcatcttcatctcttccgcgatttcttccggcgtaggttcccgcccgagttcctgcagcagctgtctgctgacacgaatgagcttgttgatcgtttccaccatgtgcaccggaatacggatggttcttgcctgatccgcaattgcacgggtaattgcctgccggatccaccatgttgcataagtggagaacttatatcctttgcggtaatcaaatttttctaccgccttgatcagtcccaaatttccttcctgaatcaggtctaaaaacagcatgcccctgcccacatagcgcttggcaatgctgactaccagacgaagatttgcctccgccagacgttttttggcatctgatccacggtcgacatccagttgcaatgctttgatctccgcttgtatttcttctttttcctgttcatcaccggtttctgccagacgctctttgagcagtggaattttttcaactgccacacttccggcctccatcttctgtgccagctcaatttcttcgtctgcagacagcagcggcactttgccgatttcctttaagtacatgcgtaccggatcctcgacacttacgccctccggaaccgaaagatcaatcttttctacttctacctcgtcttcgtcatccagaatgatatcatcatcctcatcatccccgtcactgatcctgaggacatctactttatttgcttccaggaaatccagaaccttctccatcttttcttcgtcaagattcatatccctgaaaaaatcgctgatctcctgatactccagaatgttccgtttctttttccccagttccagcagacttttcagtttttctctgaactttgcctttgtttcttccgtttccactgctgcattctcttcttttttctttgccatgtcgtttcgtcctctcaggttactttctattttgtccctaatcaatagaaatatgcgttttcttcagcttctccaattccttctgttcattgatcagctgcataacgaccgtcagatcattcggatctgactgccggcttcgaacatcaatactgttttccttgattctctcaattgtttcctttaatgctttttctttgtcctgttttgtctctacttcatgaatttttgcattaaaaagccccgcaatttctttttgttcttcctcctcctgaaaccggctgataatctttgccggattcacctgtccgctctccccatactgagtgaacagctcctgtgccgctttgcgatacagcggttccgtgaaatcttcctccgtgatccatcctttgatgctgtcaaaaagccgcgtatcctcgatcagccaggtcagaagcagcttctgtgactgtttcatgccatcttctttctttttttcatggataccgctctttaacggagccgcctttgtaatcccgctccctgccattgccagattattcacaagcttccgcagatcctcaaagccaatcctgtacttatcagcgaccgcctggatataattgttgcgctcaagctcctccggaaaggctaaaagccgccgcgccgtctcattataaaatgccgtcttggactccggatcattcatatcataattctgctccagcatacggatttcaaacagaaaactgttttctgcctgatcaatccgcttctgatattcttcggccccaagtgctttgataaattcatctggatctttgtacggctgcatgtttatgactttcgtgataattccaacttcttttaaaatcggaattgcacggagtgccgcctttaccccagccccatcactgtcatatgtcagatacacttctttggtgtagcgtttcagcagactggcatgtccactggtaagcgatgtgccaagagaggccaccgcattgtcaaagcctgcctggtgcagtgcaatgacatccatatatccctcacataaaagcagctgcggttttctggttgtccttgcaatatttaatccatacagattccggctcttgtcaaaaatcttcgtctccggcgaattcagatacttcggttccccttcgcccatgacacgccctccaaatccgatcacccggttatgtacatccatgatcggaaacatggcacgattccagaatttgtcatggcctccgcgcacctcatcgatggagacaagccccgactctttcagcagcgcatcgtcatatcccacatgtcttaaatagcgatagagatcatcgctgtactgatccgaatagcccaggccaaatttgcgcatcgtttcatccgacagctcccgcttacggaaatacgcatatgctttttcccctctcgggctgcgcaaaagtttataaaaatactttgcggcttctttgttaatctccagcagcttcgtgcgcttgtccgcctcacgtttctgtgcacctgtcatctcctgcttgggaagttcaattcccgcacgatcggcaagtacctgcatcgcttcggtaaaagtataattctcatactgcatcagaaatgtaaaaacattgcctcccgctccacatccaaagcagtaatacatctgtttattcggagaaacggaaaatgatcccgtcttctcattatgaaaggggcataacccaaaatatgtacttccttttttctgcagactcacatacccgccgatcacatccacaatgtcattgcgggaacgtacctcctcaatcagatcatctgaaaaatacggcgtggaaatcccctcctttctctagtcatcaatatccatccactttccatgcctgcggcataaaattttctttaaatttggtaatcgcatacttatctgtcataccggaaatatagtcacagacgatgcgccctttgtcttcaccctcatccagcatttttaataactttgccggcagctgctcgatatggtccatataaaaataatacatctgttccagcatggccttagcttttacttcctcgccttttgcgaccggattccggtatacatgttcaaacatgaacaagcgcagatcccgcagcgcctccgcggtctcatccgacataatgatatcgtctcttcccatactgttgctgatgatatcgtggatcaggtgatccaggcgctctctcgtggtaaatcccagcgtacgacgcagttccacgggaatatcttcctcatccagaatcattgcacggatcgcatcgtcaatatcggaattgacatatgcaatcttatcggacaggcgcacaatctttccttccagcgtgtgcggaatcgtccgtgtctgatggtttaaaattccatcccggacctcccaggtcagattcagtccttctccgtctttttccagtttttctacaatacgtacgctctgttcgttgtggcggaacccgccttcatacacctgattcagcagaaattctcctgcatgtccaaacggtgtatgccccagatcatgccccaatgctatcgcctcaaccagatcttcattcagccggagcgccttcgcaatggttctcgcattctgcgatacttcaagcgtatgtgtcagccgcgtccggtaatgatctcccatcggtgtgagaaaaacctgcgtcttacttttcagtctccggaaagacttactgtgcaggatacggtcacggtccctctgaaagaccggacgaatatcacactgcggttcctccctgtctctgccctttgaatttatggacagacaggcgtacggacttaaagtatctgcttctatctgttctattctttcccgaattgtcatattctgctcatttctgcggcacaaaccgccaaaatccttacaatatttcaaacaactctacatattatatattctgcgtgaattcctgatttccttttttattttgcatttcctccgagtactttccgcagctgttgcagacagatacccgtaatctgattttcgtagcttccaaaataaaatttgttatctttcaccagaatacatccgacccagtctccatccacgggatcttcctccagcacctgctccatgttctgatatccccgaagtgtaaaataggcatcataatccgaaaaatccgctgtgcggtaggtcacatccggaaactgcatcctaagcccctgtatcagatccgccggacatgccacatagcctgtcggctcgtgcgaatatgccgattctaaagcccagtcttcatcccagagaagaaacacatcatccgtttcccatgccttgtctgtttccaccgatgccaccggtgcatatgttcctccatcggttccggctgtctgtacgagatttgtttttccggtcggatcggtatacagaagatttgcaatcgcaagctgataaaaccgactgtcgcagcgctctccacgctctgccagatagccctgggcaattccgtttttctccagatccgcttcctcatttaccggtacataaaccgcatctccatattccatcggtcccatccgcgtatcctcagtcagaaattccgcaaccttcgtataatcccctgcggtatcttttggcatcagaagtactatcacgacaacaattgcagcagccgcaatactgcagccaaccgtcacaatctttctgatcatccggtgtctgcgcgattcttcttccccggcagatgccggtattccatctatatttttaaccgcatactgtctggatgcatagctaaatacaaatgcaccgatgacaagaataaaaacaaccattgccaacagacaggtgatttcctgccaggtccgcatccggccgcaaagcagcagatgatcgatcagacatgttgctctgcctgatgatttctgttcaaatttcaaacgacagacgccgttaattccaagacataccagtgcaaacaccgcaccatcaaccaatgcatagcgaatccaccgcaccttttcccggattacagcaagcggaaacagtgaaagcacaaacgcaaacatgatcatccccgcaaaaaaatatgcccatttttccaaaagcgatgtgttccacatctgccgtacatattccactgcggaagctccattgatatttccccagccggtgacccgggagatcagaaacgcaattcttaaaattccccataaaaccagataaccagcagcatatttccacaacagccgtcctgtgatctgacgatctgacaattcctgctgcatccctccgtttcccattcccgcacgggtccgtatccggaaaaataccagcgtaaatgcaacaaacgcaggaaatccacccatacttccgacaaacccattgataaaaagcatcaccgtaaatgccaatatggcggaaaccaaaagacgcatcggatctgcatccatcgtttcaggttctttcttatcatacttcataccatagcctcctttttgcgatctttaagaagcgcccatgccgtaattcctgccgtcagtgcttccgcagccataaacgacagccagacaccacggattccaaatatacgtgacaatatcacggaacacaccgcaatagctacaaatcctctgcaaaccgaggccgtaaatgcctcttttgcatgctccgatgcactcagatacccggttccgataatattgaaaccggcaaacaaaaatccgatcacataaagccgcattcctgtaaatgcatattccgccatctttaccgaatgttcaccgttaaacaaggctaccatcgggtctgtaaatccccagacaagcgaaataatcaaaagactgaaaacaacacccgtagccagtcccagatgcagaatctttttaaccgcacgttcattcccttctccgtaataacggctgaccagtggctgggctccctgggaaatcccgttaaaaatacaggtaaatatgagtgcaaagttggcaatcacaccataggcagccactcctacatttccggcaagccctaaaatcaggtaattaaaaagcgttgttgtcactccggaagaaaattctcccacaaatgccggcacccccagctggcaggatgctgtaagcatccgtaccgatggtctggtttttgcaaactgtaccgtatttttcttctgaaaaaaatgaatactgcagattaatatgctgacgatcggagaggctgctgtggcaagtgctgctcctgccagtcccatccccattggaaacataaacacatagtcaaggacaacattggaaaaacttcccatcatcgttccaatcatggcgagggtcggagcattgtcgttgcggacaaacgcagaaaacacataattcatcataaaaaacggtgtaaataataagaaaatcctcgtatatgtgcggcccagctgcgtgatcccggcatccgcccccatcatatgcatcaccgtatccggagaaaaaatgccagacaggacaaatggaatgctgattatgaggatacacaaaatcgcatttgcaaaatatttctttgcactgtcatcttcctgtgcttttaatatcgtataccgggttgccgatcctaccccaatcatcgatcctatggcaaaaatcaggttatataccggcagcaccagattcaatacggtaatcccgtccgttcccgctgcctgcgagataaagaatgtatccacgataatatagcaggaaatccccaacattccacagatattctgagaaacatattttataaactgtttttgaatattcatatttatatagttatcctttttgttgtgtgcatcagcatgcttcgttatacattgtcaccaggcggagcctgatgacctgcgcatgcatcagcatgcttcattataccatattttatataacaaaaaagccttgatctctcaaggctttctcacatcttagtgcggaagatgggacttgaacccacacgatcgcaatgatcacaagatccttagtcttgctcgtctgccagttccgacacttccgcatgtcttagcgactcgtttataatagcaaactctccctcatatgtcaatggtaatttttaatttttttaaattttttcttttattgcaacaaaataaaaaaaattaaaattatctattgacatattgctcagattcctatagaatagcatttgttcgcaggagtggcggaattggcagacgcgcaggcttcaggtgcctgtggtagcaatatcgtgtgggttcaagtcccatctcctgcatcgaaaaaggattcatccagacggatgaatcctttttgtttatctatagtttttaaaccatcctatgactctgactccgtttccccagccgctgcctccatgacagattccaccgacaccacttccggtccggctgtaaatgcttcctctgcatcggctgcttccatcgggtcctcatgctctttcttttcctcatcttcccagagcgaatcatactttttgcgtttttccaactgcgccatcattccggcgtttttcgccataatatagagatccttatcatattccatcagtttcttctcatcctgcatcggcacctgatctccatgcatcaggcgtcttgccacggtcatgatctttcccatttcctccccataatcttttgcggcctcgccctgctgctttgccacaacactgttaaacttaccttcccattgcgccataagctgatttacataattctgatactcgtcctgtttctccgcaaccgcattatatttcagttccagtgtagcagcttcatccgcataccgtgtttttccatccggcgtactttccatccgctcctttaactcttcccgctgcttcgacagtttgaatttctgctcgttatatgatttcagaacagaactgtaaattccccttgcctctcctgttttcataatatttcctccgtgaaatgcatccatccattgtttccttacatttcatatatcggactattcacgcgattctttatttatattctactcttcccgccattcttttagtgcagcagaaagctttctgtcaatatctattctggttgcttcacacgcatcagggtattcttttgccgctctgaatataaagtgcagcacaaatttaagtcctaccggcaaagccatacgaagcaaagattccggcagtacaaaatgcgttccatgttcatacacaaacggcatataagcaaggggctttcccttccagaagaatgttgaagcacccggaaccggccattccctgcatccatctttttactgtcttatacatatatacctcaactattcttttttgtaaatgatatcacataattctttattcccgaaaaaagccacaccagtaactatgatgtaccccaccagcgaaataacagacgcttccatgccaaattcaccgcccgtcaccgcaaatgattttgcatcaagaacataagtcatgacagagaattgatccgctttttgtccaattgccagtcccccaccgatcattacaatattccagatggcatgcacgattccactgttccagacagaaccactctcgattgcaatcattgaaaacataattcccgccatcgttcctgcaacaagaacctgcaaacagcttccgatggaaaaatccattcccagaatatgaaccatgccaaacagcaccgatggaacgataaccgccaccttacgattccattttttccttaaaagatttaaaataacgccccgaaataccatttcttcgacaaatccagccgcgattccggtaaacataattccggcacttaatgtacgaaatatctgctttccattcatatgcgaggaaacatacgcaccctgaaagaacaaaagataacttccttttaccagcagtggcaacagaatagcaattagaatccattttcttttaatatgaaatacgggcattccaaaatcagaaataggtaacctgatcactttctcaatatatatctttaaaataacataagtcagtccgacataaaaaattcctgcaatgatattacatattccatccggaatctttatcaggttcaatgcacttgcggcaagctgtgctgcaagttgtgcaatgatgagaataactatggcagcaaccgaaccgccaattacttttttggtactcatttttctgttttcctccttatgttctgctttttctgcacgctcctgtaaaccacatagaggcctgcgatcaaataaaaaacggctaatactccctgcaaaatatcatcatatttccaaacggtataattccatccaagaatttcattcataaaaaaattagaaaaattacaaagtccatgtacaagaaccggaatgaataaatgattcgtctgtataaaaagtgctgccagaaacatgccaaaacaaatcgcatacaatacctgttttgtcgtatctgcaaagttctgtcccaccagcagattccggtaatggcacagaccaaatccaagggaagacacaactaccgcacaataaattccatttttcttttttccccatgcagcaagaaacatatttaacagaattccccgccacacatattcttccagcagtccaatactaagacttgccacaccgcagatcaggaaaaaacaaatccctttaccggaaagcagtgaaaaaactttttttccatgaacgagagtcataagatcattcccaatctgtattaacggaaaaataaacattcccaataccggtaaccatgacccatttcttttttcttttcttacgaaatctgcttttttgcgaaacaatacaaacataataacaaacgtcaacacttcattgaataacatggaaatataagaactgtataaagtttcctcccagttgtccattacctttccaaccacataagccaccaatgttccggtcagttcccacaggatatatacaaagacagcatatatgaccggaatgaaataacgataaaacgcacgattctttttcttcattttctccccatccctttcttacccccactcttccacattccggcagaatccaatataggtaatgataaaatacaccagataaattccgaaaaacaataccgaagaaatcaaaaaataagttgccggtgccgcccgaacccccgtataaaagtcaaacttaccaccagtatatacacagaccagtccgctgattgcaagtgacacacatgccggacaaagataataaccggcaagctgctttaaaatcatcctgcggatttctcttctgctgtaaccaagctgaaagagaaccctgtagcggaatttgtattttacggaatcgctgagctgctgcacggaaagcacggtcagtgccacacacaaaaataccagtccgatataaaaaagcggaaacatcagcgaagataacatatatttcacttccggaatcagattgtcacgcacaagattttttgccgtataggtaacaattgtatccgaacccgaacaggaatttccaagtgcttccgtcatggcgtgcccctgcacactaattttatccggatccttctccagatcatccagccgtttctccagatccgcaggtgcctcgcctttgatatccgccaccaattctgcataatagggatgcatctgtgcaagaacggcatccggaacaataataatataatcccctccgttgtggccgttctgcgaaaatccctccgtgtgatagcccgcaaaagataatgtcccatctgttccctgaattttgatccgaccggaaaaatccccggtctgattcagcacgcggtctttgatatggatggcatactgatcttcttttaactgcacttccgaaagtccgatcatggtacggagccggttgtaatccgagagtcccatataggtatcgtaattgcaatatgccagttcttcatttttactgatctttttccagtccggtgtgccatctgcgttccgatactctgatccaaattctttcagatgtgtatacagatatgcattaacctgattcgtttcgttctcataaaccttataagtaaaaatttcctttatggctgtctcctgtttcagcagagtaatttcctgctgaaactcatccttcacattgctgctgtatacctgcacatcaaacggaaatttgctcacaagcacctcattctggaaatgattaaacataaatgccaccgaacttccgagtatcgccagagtaaacagtgccgtcagtgttcccatggtaaaccgcagtgtccggatcttagaagaaaactgccggagcagaaacagcgcatccccacagtaaatagcagctcccttttttctgacataacaggcgatccacgccgcaatgcctgtgtaaaaaagataaatcgtcagcaccagtccaatgagaaaagcgattacaactccggtatcccatgctttaaaacaaaacagaaacacaccgaatacgacaagaaacagcacagataacggaaggaaccatctctttgccttttcatgtgtttctttgatttcctcattctgtctctgactgtccatcagatcatggatattcattttgcggaattttttttggcttcgaaacagcgccagcagataacagcacagataacatgcagccgtcatcaaaatgcagtttcggttccattccagatgcagtttgtaatccagctgcaccatgctgtaaaaaatggacagaaggatctgctgaaaaagcaggcccagtcccatccctacaagaaatgcgcccgctccaagcagcagattctctgtaaaataaagtctcgcaatctcttttttctttaccccgaccagaagataaatcccaaactcacggcttcgcttttccagtataaaccgcaccatataattgatcagccacgcaatgatcggcacgataaaagcagtcgcaagtcccgtcatcacactcatcatggcatccatctgaaacagattctgcacatctttggaaaacaaaagcgtatgaaacgaaaacatgagtgcggtcacgaccgccatcgtcataaaatacactatatagtcttttgccatgcgctttacatttcgaaaagcaagtttacacatcatgggaacgttcacctcccgtcagtgtcatcacatcgagtatttcatttaaaaacgcccggcgttctttttccccacgcaccagttcatgaaaaatccgtccgtctttcagaaacagaatacggctgcaataacttgcggaaaaagcatcgtgtgtcaccatcagaatggttgcccccatgtttttgttcatctccgtaaatgtctctaacagtgtctgcgctgccagtgaatccagtgcccccgtcggctcatctgccagaagaagtgtgggataatttgcaagggcacgggcacatgcacaccgctgcttttgtccgccggacacctgatacggatacttatccttaacctcctcgattcccagaatgcgaagcagctccctgcaccgtttctgaatctcctttttgccgcgccggtgcagcgtcataacgagcatgatattttcttccagcgtgagcgtatccagcagattgtattcctgaaagataaacccaagctgttttttacggaattccgaaagctgttcttcccccagttctgtgatatcggtatctccataataaatatgtcccgctgtcacccggtcaatggttgacaacagatttaaaagcgttgtttttccggaaccggaagctcccatcacaccgataaactccccctgctgcacggcaaaactgacacgatccaccgcttttgtcacctgatccccgtttccataatatttctccacatcgcttacgcgtatgatttcctgcatcttctgacgctcctttccctcgcttgtaaataaaaggcatagtaaagaatatcattttttcttcactatgcctactttaacacgggatctttccgctttgtatgaaattacctttcctgaatcttacagttttgaaagataaacgcgttatgtctccctgtaaccggtaagatattcactcaccggaaacataagtatgatctctgttccctttccttccgcagattctgcccggatttctatatttaacttgtcacagagtttacggcacagatacagtcccattccggtcgaacgctcccggtttcttccgttcgttcccgtaaaccctttttcaaaaatccgtgggagttcttcctttggaatcccgataccgtcatcttttacccacaaaagaacaccgcttttcgtttttttagtaacaatctgaatgtgagtaccctcacttctgccgtattttacgctgttttgaatgagctggtttaaaataaaagcgatccatttcttatcgctgtataccgtatcagggcaggcaacttccgcctttacatagctctggatcagataatatttgttctgcaaaagcacctgttgtgccacttcctgcagattggtttccgcgatcatgtagtctttgtataccgcatccatacgcgcatagtacagtgccatatccacataattctcaaccttgcggttttccacaaggagatagcggctcctctcatcccagttattttcacagtttaacgcgatcgccgtgatcggtgccttgatctcatgcacccagctttcaatgtactcccggtaatccttttggttttgttccatctggtgtatccgctcgattaccgatttgttggatttgcggatcagttcccggtacttgcgatcttccagcccaaacgattccggcatcagttctccaagaagataacgcctgtccagctgatccgtaagctgctctaattttctgaaatagcctctgcgtgaaaaaaactgaaggaaaagccatcctgccagtattacaccgtaacacaccagtataatcacacatttatccatggaatagccggtcagccgcaaaaagataacaagccctgccatacataccatatgtaaaagcagcaacaacactttgtctttcagatattctgtcagtttcatatgcgatagcccatccctctttttgtctcaataaagtcgcatacaccaatttctgcaagttttgcgcgcaggcgtgtgatatttacactgagggcattatcatcaataaagacctgctgatcccacaggtattccaccagttcgattcttggcacgatctctccctgatgcaaaaacaggtaatgcaggattttcaattcatttttcgacagatccacctgctgctcctgacacttcacacagccacggacaacatcaagttccacacctttacagatcatcttctctggtacgtctgcttttttcgcccgttttaatacggccgcgatatgcgccagaagtaacggcggctgaaacggctttgtgatgtaatcatcaccgccttgcagcattccgcttaattcatccatcgaatccgtcctgctggtcaggaaaataatcggaacatccgacgttttcctgacacttttacagatctcaaatccggattgctgcggcagatttacatcaagcagaatcagatccggctctatttgcagaatatcctctaccacgtgatgaaactctgtcaataccgtgacctgatacagtgcattttctaacagcagctttaattcctgacggatggctgcatcatcttctatgattaaaatgttcatgattttcctcaaaaattggatattttttcttatcggaatcggttattttacggattaccttacagggattaccggccgcgatcacaccatccggaatatttttattcacaacacttccggcaccaatgatggtattgtttccgattgtcacgcccggcagcacgaatacattcgttccaatccagacattgtctcccactgtgattggcaaagcaatttccagcccctgccctctctgttcgctgtctattgcgtgtcctgctgtcgaaaatacacaattccatgttttacttaaatactctgacatttccgagattgtactttcatgcaaatgcaaatataattcaagcagatcctttaattcattttcataaatttctctaaccaatatagttcctccacatatttcactttgatattttaaatgataacatctttgcttaactgtttctacctgcactttttacaaaaatcgaccagcgctccatatggtctttaaaaaatcaatttgataatttatgtaaagaatttggtatgaacgcttccaccgcatttaatatttttgcgcgggcagttgtcagagaacgtaaaattccatttgaaatttgtgcatccaccagcgtttctttagaggacggacgctctgcttttaatgccctgcgtcattccgcagaacaaaacaatctgcaggatttatccttaaatgacattaacacagaaatacaatttgcacgcaacaataaagcctaagcaaggagacactcaaaatggtcaatcggaattactcttattccattttaatcaaatactctttcggcacctcttttgtaagccagactccgtttaccgataagaaaaacgcataacctgccctttccatctttccagcagccactttgtaaatcaccggctttccatgcctgcttccaaccttgactgccgtatcttcatcccctgataaatggacatataaccgactctttggaatcagaccggtcttatcaatcgatgcaacatacttctccccggttccatgataaagaaactccggcggtatggctttttttaattcaacatctacgggtatggaatgtccctggtttgcccttatgaacgtcttatcttcattaaatgaatatctttgtttattatctgtttgtacaattttttcgagcatttccatgtcaaacggccttgtctttgaaatgctttctattaactctgatacattcgcccagccgtgttcatccagcgaaattcctattgtatccggtttatgtctgagtaccagacttaaaaatttacttgtatctgttaatcccatacatagtttctccttaaaatagaatttaatggtacactacaaagattagcatactgacttacagatgtctgtccaatacaataaacagcatttttctcggcaccatttctttgttcaaatttctcttttgttgtaacaattgtaagaaagaaaaaagcagcaacgagattcaaaacaacgatgagaaaatcgttgcaaaagcaatgtaatcatatttatatgtaattctttgccataccccacttctgatccgtataaaatcgataatttgtcatacgccttttatcaatatccgccatcattttttctgcttcctcctcggtaacattgtacagtttacagatacgcgctaccttttccggcatatccccatgtataaaaacattcagcacattatctttgtcttttaagataaaatccgcattccgtcctatgatcacacagctttccttttccgcaatctccaaaatcacttttctctgcgcttcatacaccatattctctttaaaaatacatagccggccagacacgcgataaactctgtgatcgggaaaagaaaaatgctccgagaaacggaagtttctcggagcactttgtctacggtctgaggaaggcgagttgattctcgccttcctttttattttgtccagagatagatataaactcaaaataacaatttgcgtaatagccttgcaaatgaatataccacatcaagataatcgagaaatggaataagaaaaacaaatgcaataatcgaatatatcctatgcttattgtttagaggaagcttccaaaacataattattattgcgattatttctatccaaagctggatttgaaaataactaccaactttaattaacttatacgtctcacttcctaatagaagaataggaattaaaatgccaagtactgctactaatctaggctttcgtctttgaaaaataatccaacataacagtggactgcaaagtgcgactatagaccataatagtacatagtgataagggatggacttatatacgataagcgtggttgcataataactaaagaccatgctcatcataaatcccagtgtttgaaaaataccacattttatagttggtgcagtatactctatcaaacttgtaataataacaaataagccaagataattgaaaagatcttttatccctaaatagccaatcaatgtgtttcctggaataaaatccaccaatttacacagaagtccaaccaggaagccaatagctaggctgacatatatgtgctttttcatgaaaacttcactccaatattttcggattgtgttgacataatatcagaataaatggttgatatatacattacaccggcatcgtctttgattaagcacttattggctaggttgactttttgcgacaaagaatcctgtgtgaagtctggctgcatattcaatttttgctgtaactccaataaattataggacgcacctactgattctgagatatctttgtattcttcggtgatttcatcattactcattacatttaattcggaaattaatttcagaaaatcaactgccaaatcatatgtttgctcagatttcaaataacgatactgtgacaaaatatactctttatcggcttcacttatagtgacatccgcattgtttaatatgaggtaatagtaatatactttagtgttatgtgcttcgttaccctttcctttttcagcttctagtctctctctaattagatcgagcttctcatcggggatttggatgccttctaaaatgcagaacaagcattcataatatgattgtgcagatgattctgtagcaaataaattgtttttcgtttgctcttttaaatagtttccaagctctaccactctctgatcatctgaatcaaaagcatattttaataatataaatgcttggtactgttcgattatattgttgtattcaaccacataacttggatataaatcgtctactgttggagttataaaatcgtagtaacttgaaaagtactcttcagcatcaaagttttgtttttctatatccaaacacataacagcatagtaaagttcactcgataaaaaaatgtaaggcaattgttcagggatgtccccgataatctcatcgtagatacttgttgatatgccgagtgcttggcaattccagatatagtagtagagattttcatacttgtaaaaatcatcactattaaactggaaagtattttttgaactcaagtagtctttacactcacctttgaaactatcatcagcatcaatcagttgactattgcacaaattcaaataccaataaatcatgacgagccgattggcataatcagtttcagtaggaatgctactttctaaaaattgctttattttacttttgtcaaaaaaggattcattttttccaaaatattttaaaatattaaaataaccttcaattgtatcttttgtgatctctggattctctgagatatacttttctacatcttgttggttgatcttgaaatcatttagaacatctacatactttatatgtgtaatatctttctccaacttttcattgagaatttcttgaaaagcagttgtagtggtttcacttattgtcagagcagaatatttttgtattttcaaatgataataggtttgttcaaaactattactatcaatattactgagctttgatgacatgaaagattgatctgtctctatgcaatcgagtaaaaattcatcgactccctgataagcagccaatgcagatgagttagtctgaacattattctgcggagaaacattacaaccggttaaagatacaattaagatggaaaaaatcaaaaaagtcgaaatcaatttcttcataactacacctccgcattggttgtatcgactagtttgctacctataatttttgtttctatgatatttagcataaccgcaagtcagtcataatcaataaaggggtggtatggacccataccacccctttgattgctctcatactaaacattgcataagatatgcttcatattgggtaaacattcatgacattaagacgaaacggatgtctgagtagtgatagcagctttctttgttacagagccgccccaaacggaagcttcattaaccattgtgactttcttccaattaccctgcaatgcgatgtttgaacgataggatgcatctttttggctcttggtattcttataatatttatgaggagtagtagcctgtgttgtagtagatgaagttgttgcacttacagatactccaggagggttgacattcaatgttacagtaacactgtgcgtcaaggactcggattcgacaacacaccaccactcagttcggatgtttttatgatccgtcttgttgtaatgagcggaaacttggtagtcaatcaaatcattgacaaacaatgaatccaaccaaacatttgctgtcagagtaccaccagttatggttttgatgtcttccgaccaatttgctatggtagcaggaagttccatgctaggcaaagaatcatttggtgctgctggtgttgcatcttctgctgcaaatgcagttacggacgtgccacatagcattaaagctactaagctggcagataggattgatttcaatttcttgcacttcatactttttcctcctttactgaaatgttgccgtactttatcggtatctttattatagcagatatgtttaaattgtgcaatatatattaataaacgagtgttgtgcaataaaattgtgcaatattcccaatgatatataagctggagagtaattttgtaaaaaatatcatgatcgccaattcagaaacaattcaattcatcataggctcccaaattatcttttaaaaaatttgtttttcttatacacataggattaatctttttccctttttcgtgcaataagctaaatttataatctaataatgctgctggcacatataactgttttgctgtttcaaagaatgaatactcagataaacattccagaacttctctatcttccaaaagaagctctgcggcaaaaaagtttgcttcatcctcctctaccgagctgccatcgaatacttccatttcctgaaagcctttcatcatcgcaatttttgtatgaagcactgcgtgtcccaattcgtgagcaatcaagatgcgttctagcacgtcatttacattactgtcaatgacgatgtttttttgtctgtaattttattgtgtcaggcaccttgttcctttcaggttgagcagttgaatagcatctatggaataagcacaactgcttcctgtgcaattattgctgaaatcggtattgatatgaagccgtttaaaactgcggaacacatctgctcatgggccggtttgtgcccaggtaataacgaaagtgctggaaaacgaaaaagcacctctgtcacaaaaggcaatccttacataaaaagtatgctctgcgaaattgcctgggtgattgcagggaaacgcaacacttatctttcggcatggtactggagaatcaaacagaaaaaaggagccaaaaaagcgattgtcgcacttgcccgaaaacttcttgtcatcatctacacaatgttaaaacaaggaactctatttgacgaatcctgttttgaaacaagacgtaagcactgtgaacaaaaacagctttctcgttatatacgggaattggaaaaacatggttatcatgtggaagctcaaagctagcctttcttaaatacgatcaatctctcactacaggcagccaatactgtgactgctttatagtgatgctttcataattgttgaaaacatttgttgtcaaggttcagtttttggctacgagttttattttcgtagcaaggttcagtttttggctacgagttttattttcgtagcaaggtactgtgtggcacgaaattaccaactgcaatcatcatagcggactatccttgacaaaacaatgcttcttcgataccatgagtgtaacggatataactaaattatataattaccatagacaaaggcaggggatagggatggagaatcagtttatacggcatgagccatgttttgagaggattttgtttgtcctgacgctggacaggaagaaaatgaaagagcggattttgattggggaagaacagcagatccgcttccggctgaacgggagccaaaacgcagaggtgctttgtgatatgacacgcccgctgggaacttttttgataaactttgagcgtgacacggacagagactggaacttatacgggctttctccgctgcggcaagccctccactccaaccgatggaaacagccggagctggaacaggcggcaagcgaatttctctggggaaaatatcttagcaatgaccctctgaaaatgtatgtggcgttccgtatctggaacagctatctgcttgccagagaacccgtgaccgtaacactgcctgtgaccgcttcatagataaaatgagcagactgaccggggtattccaaaacgaatccatgagctttgacagggagacaggaaaaccgaaacattttcaagctggcagcctttatttcaaaggcgcaccatcagaagatacccgacttgacctctggttcccggacaaccggcgcacagaagaatgtgtgtctgcctatgcgtccctctacccgttgattacctattatctgaaccggctgaatgactgggggctttgcttccggcagtgcaaggtctgtgggaaatattttctggcaaagagccagcggtatgaactgtgcagcgacaagtgccgaaaagcacaggcgcttcaaaacaagcgggaatttgacgaaagggcaagagaaaataactatgacctgctttataaaaatgaatgccagaactggcgcaacaaaataaaccgggtaaaaaataccgcaggctttccggctgaccgtctggaaaaaatacaggctgccttttccgactttaagaaagaagccttgcagagaaaaaaggctgtaaaaacaggaacagccagcccgaaagaatttacggactggctgtatcagcagagtaatgtaattgtggagctgacggattattaaaacttagcctatcgttctaatgcgctctataattgagtgctgttgcaaagatttcttttgatatactgatactacatgatagaccatcacaaccgcagcaaagtataaaagcacaaaaagaactgggaagtgatattcaaagtatgaaagtccgggaatttttgatatttgggtacaaagcagcaatccgattggtatgcctaaaatgcagcttcctataaaacttccaaccagatagatgaaactttccgactgctgtacttttcgcaactgcaattttgtcatacctgtagcttccagtagtgcatagtcgtgtcttctggcaatggcatttgtaatgctggtattcagcatatttataaatgaaaacagactaataagcaccaccaaaactgtaatgatgactttcgcattatggaagtaatcttccaatgccataacatcatcagccaaaacagacacatcaactctgtcgtcatctataaaaatttctttgattatctctgttgctacgtcttttccgttatcatccaaacaaatataccatgcaagcgtacaattcatttctgacagtgatttcatattttcaccacttgtataaataacaagcccagtatcgctgttttctacaaatccgcttacaactaactccacttctttttgaccatatcctgtatctatgatatacggcagataatctccaacttgaagctgcatattcagtttctgataataaggagactgtctattgatagcaacaggaattgctccattctgtaattcatgacttggttgcataccctcaacaatttcatttttaaatgtttctggatttacagcattttcaatggacagttcaaatttttccccctctgaatttgtcagaatgccgtccagcatatacaattcataaacatcttttacacctgaaatgttatacaatttttgctttttttcttctgtaaatggtgtagatttcattaaatcataggtggattcttcatcagccgttgaatttagtagtacaaatacatcactatttccctggtaaggttgtgacgcaagtctttcgggatttatcgcattcaatattgaaaaaacaccgaacattaaaatcccactcataatgagagataaaaatgtataggcagctttctttctattggctctacaatacatccacccgattcttataggcgtaagtttacgctttgccccaacacttctaaaatagtttgttgcctgtgtatgttgtgcttctattggtgatgtagatgcagccattttcgctggtgcttgaaaagccaaagctgtgataatccaaataaatatgccggagattaccgcacatacaatgcttggtatccagtaaaaatgaagtggtaaaactatgtttaccagaaaaccgatgactgttcccaacacaatgcaaggttttgctattttgtcacgttctttcttgaccactgatttaatttgctggtatgttgcgccgattgcccgtaattgtgcaaattcatgtactcgttgcagtacagatacataaagaatatttttgacagccagccctgccgtacaaagaagtacaataacaattcctaaaacagttcctactgcttcagttgtattatttacatgggcgatctgctgcgtactaagcgttgcattgcacaaaagaataccagaaaagctcaacagaaatgccgcaatcaagatgataactctgattagaaatgtcctattcttttcagagaatacactcttttcagcaatccttttctctattctctctgtatcattttcaaaaggataattcataattcccacctcctttaacctacaattttgccatcctcaatccgcacaatgcggtctgcgagctgggcaatctcgttattgtgagtaatcattacaatggtctgattaaattctccgctggtacgtttcaaaagccctaacacatctgcactggtcttgctgtcgagatttccagtcggttcgtcagcaaggacaatcgccggctttgtaattaaagctcgtgcaatcgctacacgctgctgttgaccgcctgaaagattgtttggcatattttccagcttatcttctaaagccagcatatacacaacttcgtccataaatttcttatctacggtatcaccatccaattccacaggcagggcgatgttttcatatacattcaaaatcggaaccagattgtagttttggaaaataaaccctatgttacgacggcggaaaattgtcaattcatcatcattctttttcgcaagttcttccccccgtacaatcacgctgccggaagtgggggtatcaagtcctcccatcatgtggagtaacgtagacttgccgctgccggaagttccaactacggcaacaaattctccctgttccacagtaaaatttacaccatcaagggcacgagtgatgtttggttctgtgccgtaatacttctttaagtcgattgtttgtaaaatgctcatattcaaatgctcctttcaaggctttctacctgttgatgaagtcattgtaaaccacaaatgttacacaaatgtccgaggtaggaaaaatttttatcgaaaatcgagatgaaatgttacaacgctcggacatttcaaaaaaagtggctgtatcttaccttacaggaagcataatagaaaattctgagccttgccccagctctgaaacgaccttgatatagcccccttgccttgttacaatctcacgagccaaatacaaacctattcccacaccctgttgatcgtgtacttcttcctcacgatagaagcgccgaaagatggcagcctgattgctttctgaaatgcccctgccggtgtcggtcactttgacctctacgtacatttcccactgaaccactgatacagaaatctttccacctgacggagtgtattttactgcattgtccagcagattgaaaagggcttcgcttgtccacttgctgtcatgggagattatcaaattttccgggcaatccacggatacagcaatttcttttttctctgcggcatatacaatactgctcatagcttgtgcaagcgtatggaataagctgctgtctttcttttctaatcgtattgctccggtttctaaccgggatgttttaaccagtgcttggaacagaaaatccagtttatcagtctgactgcgtatgccttgcaaaaagtccatccgttcttcttctgaaacaggctttgttaaaagtgtgtccgttaccatttgcaaattgctgacaggcgttttgacttgatgcgaaatatcagaaatcagcatttgaagctcctgtcgttccatgtctaccttgtgccgattttcctgcataatctcatacaaccggattaagcggtggttgatacgggcaaaaagagtttcactatcatttgacttttgtaattcctcgtttccatcaatcatgttgtccagcgtccggcacaaattagaagtaaaatgagaaaggcgttttccaaaagacagcaccaatagccaaatccagaaaaatgcacagagtgtcaatgttccacctgctatgaaaattcgtatatcctgcattataccgccgagaataccggtaattaccagcatagagaaaaccatgccagcactaatcagtctacaaattttcttagcagaaaggttattcagtttcatttcttttcgcctcctgtccattgataacccataccgtaaaccgttttgatatatgtgtcgccatccgcttcaatcttactgcgaatgcggctgatagaagtagtaagggtatgttcatctacatatttttcatcaatgtcccacagcctttccaaaagttgttggcgggtaagtacctgcttcggatttttaagaaataggttcagcattttatattccatcgcagaaagcgctaatggtttcccgttcaaacttgcaaattgttccgaaaaatccagaaacaggctaccatcctcgtaaatatccttagctggtttgtgatgttccaacatagcgaacatggctttgatctttcgctgcaaagcactaatcgaaaaaggtttcgtgatataatccactgcaccagcttcatatcctcgtatctgatcgctttcctgatcgttggcagttagaaatataactactgtatcaggatgctctggcttgataagacggcataggtcataaccatttccgtctggtaaatttatatccagcaataccaaatcaaaaatgtttgtttttaatgattcagcggctgtccttgcattcagaacagaagttattgtgtaaccgtccaattccaaattataagtaagcgttttattcaaaagattatcgtcttcgacaattaaaatctgcttcatattgtcacttccttttctttttgcagatagtataacaggcaaatgtccgagaattgttacaaggacaaatatatttattattttacagcttttttctgtgtactgcaattttatataaagaaaggacagcagtgtcaaattgctgtccttacggcttattatagctggtagtgtataagcgtgggttcatcatatttggtgtggtatctttaactatgggaaactccagtttcccattttgaaactgctctatttgtaatattcaatttttctgctaactgcatttgcgtcaagcctttttcttttctacattttgcaataaaacttcctatcacttcttgattcatttctcttacctccttgcagtcatcatatatcaaaaaggagctgtctaaaacgaactgctagttgatttatgccattcaactggtagttgatacttttttgcaccattcatttacagctcccgatttgtcatattcataaaagactatttttcataactgtatcataatccagaaaagaaattaaattttctttttcaatccttttactatcttatcaaaatcagattcaatcggctgtgtcttgttaaaaatatcatattcctgatatgctttctctactgcctgcttatgggaaatacgtccgttatctttcaagatatcgtatctgcggaacgcaaggaactcgttcacgctttttgaaaattcctccatggtaaagacgttttcacgttcaatcaaatcctctatgtaatcaaaatatcctgtaacagcacgttccaattgacgaatctgtttttcgtccaaatagtttttggcaatcggtgtatcagatttgagaatacgaccatcgggagcatttttccatgtggtcaatcccatattttccttggtgtggtcagcctgattatagacgatttcagccgctgttttaccggtaatggcataatgaaatttgttctgtatggttgcgtaaaaatgatatgcagtatcagaatctctattgtaatcaatgctgcactctgcaaagatatcggttatctgttgccatattctgcgttcgctggcacggatggagcgaactctttccagcaattcacggaaatagtcttttccaaaagctgttttaccctgtttcagacgttcatcatccatagcaaagccctttatcatatattccttcaaaataccggttgcccatatacggaacctggttgcctgaatggagtttactctgtaaccaacggaaataatggcatccagattgtaataattggtaggaatagtctgcgttttatcctgcattgctccgtgctgagtggttgttgcaatttttgcaacaaccacttcctcatccagctcaccggattcaaaaatctttgctaaatggcggctgattcccgacttgtcaataccaaacaattcagccatggctttttgtgtcagccatatcgtttcatcttttatcaaggcacttacagtcacgttatcatcttcggttctgtacagcaccatttccatttgttttgtaatatctgtattcataatcagccttctttcttatagcaggtgaattagttagtgttgtctttatccttagcacggctcttatacacattataccggtttttacatttaccactgcaaaatacgctgttgggtctgctggcaacaaaggcttttccgcagtgtttacataccttcagtaaggacttttcatctgtaagcataaaagaaacatcatctgcacacccaatagcagagaatggaaatcccagacaatggtaggacgttcaagcagctctatgtgatatgttggtgcaataccgccaaatgccatgagtcctacatagataaagcctctattttttctgcattatcacaatatatctctattgcatctgatacaaaatttgctgtaccctttccaccataaacatcaatatttgttgtaaagtctccgccacctgaatacatttttcctagtccacgcagaatcttatttgtgcaagtatataagttttccgtaatataatcctgtattctttttacaagattctgtgcgtcatcggatgccgggtcactattttttatttttccagcctccttaaataaaagcatgaatctatctgctaagattttctcatcttcctcggtacgattcttctgcttttcttccatttctttgtattccggtgtgctaccgtataattcctttgcctgtcttgaatattcatccaacttacttctgtcaaaagctttaaagtccatatgtttcactcctaataattttattccaagtgcaaagttcatcaagttctcaatatgttcctttttaagcctaagcagctctatctgttgctccaaggctttgcttctatcaaaatccggactatttataattgccttgatgtccttaagtggaaactctaattcacgaaacagtagtatgtgttgaaggcgttccaaatctgcatcgtcatacagtctgtagcctgcatcggtgtatcccgtcggatgtaaaagaccaatcttgtcataatattgtagagtgcgtatactcactccggcaagcttgctcacttcatgcactgtcatcattaatatttcctcctatctttaacttggtgttctaagcataaactattacgtaacgtcggagtcaatacttttttacaattttatattcacctaaagctatgaatctatacgactaacaggttatattttctggctctttgtattcttttttaaaatcaaaagccataattaccttgtatgataattaggaagttaattatcacacgttccctttcttttaatatcgtggttcaatacaattcagatactatggacttttgatttttccctgtagcttgactactcaactggagtgtattgccgctacctttatctgaattgtttatcagctggatgttgccggagtgtttttcactcagagtacttatttctatcaagtctacgatgataatcgatggtggacatcatggtatcagactttatgaaagggaggtacaacctcatgaaaatttttgtaggcattgatattgccaaactcaaccatttcgccgctgcgatttcttcggacggtgaaatactcattgagccgttcaaattcacaaacgacgctgatggcttccaactgctggtctctaagctcgaatcattcgataagaacagcatcatcatcggtcttgagtcgacggcacactacggtgacaaccttgttcgataccttgttgctgagttctaccaagtgtgtgtgttgaaccccatcaaaacctgtcaaatgcgtaagaacaatgttcgtaaaacaaagacagataaggtcgacacatttgttattgctaaaactcttatgatgcaggatgacctaagatttattaccttctttgatctcgatatgatggatcttaaggccttggggcgctttcggcagaaaaccattaagcaacgcacccgattgaaaatccaactgacaacctatgttgatcaggtattcccggagattcaatactttttcaaatccggtctgcatcagaatgctgtctatgctcttttaaaagaagcaccttctccaaaagagattgcttccatgcatatgactcatctggcaaatctgctcaaagtgaactcgcacggacactttactaaagagcaggccaaagaattaagagttctcgcacagaagtctgtcggtgccaacgacagcgctatatctattcagataactcaaaccattcaacaaatcgagttactggatagccaattacaaaagattgaagctgagatgacggatatcatgaaattcaacgattctgtcatcatgaccattcctggtatcggttatatcaatggtggaatgattcttggtgaaataggtgatattcaccgtttctccaatccaaacaagctgcttgcttttgcaggtctggatccttctgtttatcagtctggtaactttcaggctaagacaacaaggatgtccaaacgtggctctcgtgttttacgatatgcccttgtaaatgcagcttggaacgttgtcagaaacaacgcgaccttcaaggcttattatgatgccaagagggctgaaggccggtctcactacaatgcacttgggcactgtgccggcaagcttgtcagagtcatctggaagatgctcactgacgaagtagaatttaacctcgaataagaggtctgtataccaatatcgatagattttgaaaaagcaccttaagggagctctattaaagttacccttttttaccaccgatatgaaaaagaaatttttttgctaatttatggttgacttttcatagctggtctccaattcaattttctcactatttattttagcacgcacaattcttatattccacttatgtttttctaaagattttatgggtggactgccatacatagcaatccacccataaaattaccatacttctagattatcttccgcattcacccaatcttgcatctcacccgtcaaagccaacctggcatactcaatagggttgtcaatggcaagagcatttaatgcacactgagaattaggtgtggtcatcaatccctgcctgcgcaatactctgtacgcgcattgcaagatccatccacgaattcatgatctacttttcccactttcccgctccgacaacggcacttcgtttttcatgtaagtatcccacacatgtatccggtcctgctcatccagtttccgcagtacctttgcaggaacccccgccacgatgcagtcatccggcacatcacggtttacgaccgctccagccgcaacgatacagtttttcccgatggtcactccgccacagatcgtcgcgctcgaacagatccagcttccgcttccgatgtggatcggctttgcatactcaaggtcatggaaaccgtccggatactgctgcggcagacgctcatcggagaggaacggatggcacggtgtcgcaatcgtcacatttgcgcctacccacacaccgtcttccagcgtaatcggtgcacagtccagaaacgtgcatttatagttgacaaaacagccttttccaaagtggatattgacaccgtattcacagtaaaacggtgcaaaaattgctgccccgccatcctttgcggatggaatcattttttccagaagacgctgctttcttttcttcatccacagcggtgtgcggttgaatttatcacaggtttccatcccaaacgaatgatatttttccagatctttgctgtcggcattgtagagtctgccggctttcattctttcccagttattcatgtctgtttctccttttttctgatcgcgtaccttattcttctttctccagaaatgtctgcacattttcttttgtaactttctgatattcgcgatatatatatttataatttttaaacggatttggattattttcatcctttgtagcaatcgaaaatgcaagatttgccattgctgctgcctgcccttctttatcattatatacggttgctgcaagtgttccgtcttttaccgcttcaagcccttcttttgtcccatctattccaaaaaataccggccggtttgtttccgtatacccgagcttttcataagcatccatagcaccgagtgccattgcatcattattggcaagaacaacttctatccggttgttatattgtccgatcagctgcatcatacggttctgtgcctgcacacgattccagtttgcaatctgataactcagtttttccagtgcaatcccctgttctttcaggctctccgcaacgctttccgttctaataatggcatcctgatgccccatttccccctcaagtatcacatactggattttcccatcatgattgcggtccacatccggacgttctttgatataagctgctgcaagctgtccctgcatctgtccggattgttttgcttctgctccgacataatataactgatcccactgcatcaggtcttcttccacaggttccctgttaaaaaatataatgggaatatcgtgttcctgcgcggctgtaatgatctgcgacggatccgtccgatctgccagattgacgcacagaatatcacagccattgccgatcatttcctgcacctgatcgtcctgcgttctttgcgaatttgcagcatccataatagtcagactgatatcatatccccttttttccagtgtcctgcattcccttttaaaattttccagaagttcccccagaaaggtatctctctggtcataacatgcgacaccaatataaatctgtttcggtatttcctttttttcgcttccacatgcaccatacaaaagaattcccatcagaccaattaatgccatagcgttttttatttttcttttatccatgataacctctgattttaccggctgattgtaaacagcagattccggttctcctccgaaaaaagattctcccgtgtgagaacggtatatgtaatctgccggtctttcattttatagaaaaaattacgtcgttttttaataagttctgcaacactttcatagcctgcgtcaaactcatccggagcaaccagacattgtgcccatcctgcatccagataataaactgcctccgttgaatttccaattccatagagtaccgccccatacaggtcattatcctttgccgcctccccggcttccacaaagcttgcattatccaaagccatcacgatatccacccttctttgcgtctgtaaattgattttctctttcgactcattttcttttgatacagaccataaaatttctgcgccactcccctttaatgtatcacaaatccccttctttctttttatcactgcttctgaagtggcatactgcgaatagatcccaatcttcttcccgatcagatttccacggtaattttccagaagcttttgggcaagatccgcacccatatggtaatgatccggttctattgtatgtaatccggacggttcttcgggaaatgtatctcccacggccattacgggaacacttttttccagctgttttagcttttgcgtcccattctggtttgcaatcggttttacgatcaccgcatctgctccttttataatttcctgattcataatctcaatctcatcattagcagtttccatattgtccttactgatgatcacaacatttgcatcatattcccgtgctgccattttcagtccgtatttaaacgctgaccactcgctctcatccacatccggtatgatcaccgcgattgttgccggttcatggccgttttgcttatagatgataaagccgagaaccagaatcacgagaattcccagtactgcctctattatcataaatgattttttcccatgtttcattttaagaatcctccggcatatggtgttcctcaaatttcctgcagttttcctcactgtaaacaatctctgggatgataactgtcactgtcgttccctcatccagttcactttctatctgaagtccgtatggttctccaaacaataaccggagccggttatttacatttacaagcccgactccggagccctttttatgtacacggtttgtatcctttaataacaggtcaatctcctcttccggaatccccattccgttatccgatacctgcataaagatattttcttgttctttccatccacgaatgaggatttttccgcagtcatccatctcccttactccgtaattgatcgcattttcaaggatcggctgcagcacaagtttcacgatacaatcatccagaatatccggacggatatcaaatacaacttcaaacttgtttttataccgcactttttgtatattaacataactttgcgcgtgctgcagttcatcccttatgcggataaccgtatgtccttttgaaaggctgatccggaaaagctttgccagctgcgtgatcataaaggcagcttcctcatttttaccgctctctatcatccaggtgatggagtctaatgtattgtataaaaaatgcgggttgatctggctttgcagcacatcaaattcgctttttcttctttcattctgttcccatatgacttttttcatcagttcggaattctgccggtaggattcctgaatggattgtcccagatgccggatctctgttgagcctccgattgcaatcttttcttcttttccttcctgatattcacgcaccgagtgatccagtttcataatcggccgcgatatccgcacggaaatgatgcggtttacaaatacaagcatcattgccataagcagtaaaataagcaggacaaactgctttacatcggccatcttatttgtgaatatttcatacggcataacacagaccaggcgccatcctgtataactgattgcacccaccataacttttctgtggttttttcccaaatattcatcgtaaattttttctttggacgaagctgcctttacgctgctttctgtattcatgccattgtcaattcttgcctgatgcggatgataaataatatttccctcaccatcacacagataaaaatacggtccttttcctgacgtattgatccgttccatcatacgcgaaatcccggaatagtccatatccacaagcagcactcccaactgtgtatctgtcccattcgtaagttccacgacacggctggaagaaatcacccagtaataccgacaggtaccgtcatcaaataaattctgtacatggggtgtggaaaaatggatattctccatacgtgtttttgcctgcataaaccatccctgtctggtcacatccggttcttctttctgggcaacaaccggctctgctgccataaggcttccgtatccattatatatagcaatgctccttaagttctctttatttgcctcatataaaagatttaaccctttgtggatggaatcgttctgttcccggatatcgttttcctttataacatcataatatgcggcatccgataccagcctcatattcacaagataattttctatggaatccaccgtctgatccataatctttcggttattatccacaatattctgctgtgtgatccccgaaaatctccaatataccatcatgcccatacaaaccataattaaggttgatattacagaaaatgcaaccatgatggttgactggatatctcccggtttatttttcatttttttcatatgctgtcctgtattttgaaggggataccccaaactgtcttttaaacacataactgaagtaatttggatcggaatatcccacactctttgcaatcatataacttttttctgcggtttccacaagcatgcgtgccgccttatccatacggtattccgtcaggtatccgacaaaagaattccctgtttcttttttgaacatgcttgaaaaataagaatttgacacgcccagttctttacagatatcgtcaagccctaaatcttcctgctgataattgtcgtgcacatattcttttgccctcccgatcagggatttcttggaatgataccgggcatctgccatgtcatcatgcagcatacagcagaattttaaaagccatttctgcaaaacctgcggttctaaattacacagttcattatacaaagaaccgatacctcccggtatttttgtggtatccatttcattgttgaccataaaatgatacagttcgccaatgagttccataactgccacatgatatttttccaatgatttcaggtcaaggaatttatgctgcatgtaaacttctatggcatttgcaatatcttcattttctccaaggcagatctttttgaacacattggacagttctgttttctctccggcatccctttggatttttctctgtggaacaatctcttttaaatttatcgcccggttgcttccatataaaacacgataggaaaccgcttccctggcgctttgatacgatgctgcaatctttgcaatgtgcccacatacctgaccgatccctatggttacttttgcccccataatatgatggatatatttacagaaacggtcacaggcatccgtcagttctgaaatttcttcctcactttttaactgcataatcataatggtatccccaagatagcgaaaacgcttcgcgttccatttttccccgaggttctcccctgcctgccggtctaccgataccgaaagcagccgtatatccatgccctccggaacctgacttgccgatgtgtgtatgatcaggcagcaataccacgggcctgtaaaagcaatctggtaatccttaaaataatgcggcatctcctcttccggaatacgtccttcaataagcgttgtatacaaattcgcctgcagcatcggaagggaatccgcataatattttttcaaaagatccgtatttcttttttcactgatctcatagtccagtttctctttcagacgcttaaacacttctgttatttcaacagcattgagcggctttaaaatatattcctcgatttcaagatgcacggcttcttttgcatattcaaaatcatcaaacccggtaaaaagcagaatttttgttgccggatactttgcttttatatgcgcacacaattccagtccgtccatatacggcatccggatgtccgtcataacaacatccggctgcatttcttcaagcatgtccattgctttaaatccgttgtttgcatgcccggtaacttgaaagccaagttcctcccatttgacttttttaacgatggcttcaatgacttcttcttcatcatccaccagcaataatgtatacatacctcttcccccatgttattttatttattatagcaatttgtccagataaagtaaaacctttccaacataaaacagagatgccctgcatgtttcatgcatcaccggcatccctgctttttcattatagaggagagtatatgttttattttttctgaacgtatttcagacaatccagtgttactgcaacaaggatgataatacctgagaatacgaactggaggttggtatcaatacccagtattgtgagggagtatgttaatgctgtaaagatacatacaccggtaacaacaccggaaatcttaccaataccaccggtaaatgatacaccaccgacaacgcaggctgcaatggcatccatatcccagccctgtccataagcggcagaaccggatcctaccattcgggtacattcaagccaggaaccaaatccgtaaaggatacctgccataataaatgcaccaagtgttactgcaaagacagaaattcctgaaacagctgctgcctccggatttcctccgactgcataaagatttttaccaaaggttgttttgttccagataaaccatacaatgacaattgctgcaactgcccagagaatgatggtcgggaatccattgacttttggaattaccatattcggaatggtcggctcgatcgctccgaaggaaacaccttttgtcgcataggttaccagtccaaaaatgacaagcatgtttgccatggtcgatataaacggatgcatcttgaatttcgctgtgaaaaatccggctatacttgtaaagaacgtacataatacaatacatgctaccagtgcaagaacgactcttgccggtgtcggtactttcgtaaaatcaaatatgtgtccgaacacaccacctgtatttacaccctgatgcatgataatggttgcggttgtcattcccataccaaccattcgtccaacggaaagatccgttcctgtaagaaggatcagacctgcaactccaagtgccaagaacattcttggcgatgcctgctggagaatatttaagatattgttataggtaagcagcggcgttccttttttgattggagttatgatacataacgcaacaaaaataagaataatcgcgatgtagagtccattctgcaaaaggaatgttctccggttaaatgtatacttataattttcccatttctgtgcctgattttctgcaaatgtaaatttggacaaccggagcagatcaatcagatgatacttgtaactgtacgcatcatgcttccggtctttgatcctctgatactctttttccagttcgatcttttcattggaaacacggttcttatatacataattttcttctttgacctcggcctgggcggaagtctttgccagagtttctttgtgttccttttcaatctttgcaagtctctgctgatgctcctgcagtgcctgttccttttccgctatacagcttgccttaactgcattataatacttgtcaaaattatttttgagataattttctgctttcccgatgagttttgcgatctggtctttgttctgtgcctctaccgcttttgcctgttcaagctccttctggcaggatgcaatctcagaatctttttcccctttggaaagtgttttatctctttttacgttttcgatcctgctctggtacataatgacttttgccgtaccatcttttctgagttcatcaatctctttttgtatttttccgacatattcctcaatcggctgacgcagtgttttttcctgctccgctgtaagaatcttgctatttgccatatctgtcccccctgcctataaatatttcgcgctgaggcgaagtaattcttcctgattcgtttcctttgtattgacaatgcccgcaagccgtccgttcgacatgacaccgatccggtttgtaataccaaggatttccggcatctcagaagaaaccacgataatggtctttccctgttttgccatctgtatgatcaggtcataaatttcatattttgcgccgacatcaattcctcttgtcggttcatccatcataaacaccttcggttcacgctcgagccactttccaaaaataaccttctgctggtttcctccggaaagacttgaaatcatatcgtttggtcccagacatttggtatgcatgactttaatttcatttgcggtagcctttgtcattttcggttctgaaagtgccgcgccttttttatatgcattaagatttgcaatggttgtattaaatgtaagattccctttcaggaataatccatttgccttccgttcttccgtaataagcgcgaatccataatccattgcctcttttgcacagctgaaattcataagcttatggttcagataaacacggcctgcggctcttgtgcggataccgaatatggtttccagcaattctgtccgtccggctcccacaaggccatataagccaaaaatctccccttcacggacatcaaatgtaacatcctgtaaatacggctcatattttgtggacaaatgctggattgataaaataacatctttcggctgattatccaccggtggaaaacggttttccagcacacggcctaccattgcagtaatcagttcattcatatttgtttcttttgcactttttgtcatgaccagatttccatcccggagtacggaaatatcatcacagatctcaaatatttcatccattttatgggaaatataaataagggagatgccctggtcacgaagcatccgcatcatatcaaaaagtttatccacttcctgtacggtaagtgatgatgttggctcatccaatacgattactttcgaattatatgagatcgcctttgcaatttcacacatctgccgctgggaaacggacatatttctcatcggctgatccagattcaccgtcattcccagtttccggaataattccgaggcttcatttttcattcttccctcatcgatcatcccaagggaatttaccgggtatctgccaagaaagagattatccacaacatttctctccagacactggtttaactcctgatgcaccattgcaatcccattttcaagtgcatccttcggaccggaaaaattcacttcttttccgtcaaggtatatagttccttcgtctttctgataagttccaaaaagacatttcatcattgttgacttaccggcaccattttctcccataagtcccataacggttccttttctcacatcaaggttgatatgatcaagtactctgttgcggccaaatgatttactcatgccacgtatcgataagataatatctttgctctgatcccccatactatccgctcctatccttttgttttcggggagagaaccgtatccccccccgaagttaagttgttttactgatttaaaagagctgtgtaagaagctgcattatctgttttcaccatgttgatagcaaaagcatcgtactgtcccggattgcccagacggtttgtgatattagactctgtctgtccgtcaccgccaatgtactcaacatccagatttaaaaggtcatcatacttctgtaacagcggctgataagtagaactcaggaagttatcagaagcattgtaaatattcagccataccttctttgtcggatgagcagatgcatctaactgcttggataccggttcccatacaacggtagaatctgtaaaatctttgtagttatcagaggttactgccacgttcagggagtagtaagatctctcatcttctttgtatacataaacgtcactgcttaatacatttcctgcatcgtctgcagttccgatacccgtgtcaacatctacaccatccagtgcatttctaagaacacgcagtgtcaggtatgcctgtacgtctgcatgctggctgatcgttccgccgtagccttctgcaattgctgcaaccgcatcgctgtttgcatcatatccgaatgtcggtacaccgttatcctttgaccatgcattaaacattgacattcccattccatcattgttggatacaacgacatcaatggaatccccgaaagaagatgaccatgtaccaatcgcattgccggctgttgctgcatcccatgtagcacctgctgagtttttcatttcctgggaagcaagttcacggatcacataggtttttccacctacttcaatgcttccgtcctgaacctgtgatgcttttccatcggtattggttcctgccggtgcactgtctgcctcgccgtttttatccactgctgttccaagtgcttttctgacgcctcttgtacgggcaatggaatcattgtgaccgatatcaccgattgctaaaacatagccgatcacgccatctccgttacggtcaatcttgtcaatatttttctcgatgtaatcttttaccatggtaccctgaagttctgcaccctgatttgcatcaaaccctacataataagtatctttgttaaaattgagtgctgtcatatcaagctctcctgtggaactgtttgacggctgacggttaaaccataccaaaggtttatccttgtttgcgacagttgaggtagaagtgcctccccctttattgcctgcctgtgtgccaccgccgttgtttcccccatcggctccacatgctgcggttgaaagtgcaagtaccgccatcatcataattgcaacaattttctttttcataagaatttcccccttcttgttttgtttgtaatgctagtataagaggttttcatctcataaactatagaatattttttgattcacattaaaaattttcatatttttccgttatttgttcaattttttcatattttttctttgtcatttcgtcactttaccgttgatttatactaaaaaaagccatctttctttacaaagatggctttttaaatcttttataaaaggctctgttatcattgttccagaatcacatgccacgcctcacacagccgttccagcgaccacgcggcatttgccggacttgtggatggaagcaccatcgcttcgatccccgtgaccggaaactggtatcttttataaagctgtcctgccttgtttccgtttgcataaatacgtgttatgttcgttttttccagaatcatgccaatatccgtcggctgtacatttttaatactgctgtcacttgagcctttgatgtcacagctttggatcacatcccacagggcaatccggtgggcaagaagcattgcttttttctcctcaattgtatccggaaccggctcctttaaaagtgttgcaagcactttccagaaacggttctgtttgtgcccgtaataaaaattgttttctcttgatttgacggacggcagggttcctaatatgaggatttcggaatctttgtcgtacaccggctcaaacgaatggacaatgtgttcatattccatgggattctccttttaaagttaccaccctatccgtatccatcttactgcttatccttctctaagatctggtcaatcgcagctgtcacctttttgtaaacttcatcactcgtgattccgcccatgattggatctccgacaatgttgccattacggtcaacgagaactgtcgttggaaatgccataatatttgttgcgtatttaccggcctcactgtccgaatcaagggaaaggttggtatagtctgccccctgttttttcaggatgctttttgcttccgcaattccctctttattaccatcgagtgaatccgtgtttacgccaatgacctgaccgccctttgccttcagttcttcatttaatttgttgagtgccggaagttcctccacacatggcgtgcatccattaaaccagaaattaacaaccgttaccgcattctgtgaaaaaatgctgctgtccaccttatttccatccagatccttcgcctgaaaagacggaaagacggatgtttctgcattcgcgctttgggcgccggaattttctgttcccatctgcgcggtaagttccgttacctgatcctcgattttcttaatctcttcgatatccttatccagctttttcaggtctgcctccgaaaactggtccttcacatgatccagctgtgtctccagaaacgttccataattttgttctcctgcgtctgcagctttgtctttgtcaatgttattaaaaaccgtattccacaattcctgatgtttcgcaataatggcattttccttttcgtacagtttgttgagttctgcattaccagcccctgtatcttccgcagactgtgcctgtgtttccgtcacattgcttccttttttcgaggcattgccacaagcagtaagtccaaataccatagtcataaccagtaatattcctgtaagttttttcattttaattattctccttcttcttttttgatttttccgcaaatccatacttataactgattgcttccaccggacattctttcacgcaggctccgcaacgtatacattccgtatgatttggatgcctgaccacatccacatccattttacagacaccggcacatttgccgcaagatacacatttaccggtatctatatgcatctgtaaaagagatactttattaaaaagcgcatagactgcgccaagcggacagatccatttgcagaacgggcgataaaacataaggcttaacaacacgaccgcaaccagtattccggccttccatgtaaacagctttcccaatgccgcacggatgcctgcatttgcaatcgaaagtgaaagtgccccctctaatactccctgtggacagaggtatttgcaaaaaaatgggtcccccattcccagctggttcgtcaccaatataggaagcagaataacgaaaaccaaaagaattccatatttgataaaccgaagcggctttaacttccgggtggatatttttttaaatggaatcttatgcaaaagttcctggaaccatccaaacggacacaaaaaaacacacacagaccgtctttgcattaccacggtagatctctcccttaaaaaaattcggcagatgaatattcgtaagaatcgttgccacagcctgaatccacccacggacatgtgcaagaatatgtgatgccttatgcttttttttatccaatgccaacacactccagacataatttaattgctttggagagtaccgtggctgcctctccacgcatcgcgccataacaaaccataagcattgctgctgcaaggagcagcagctgtatggctgctttcttttgtagtttcattccctttcattcctttctttttgcttgttacaggttatcagccaactgtgaacgtcctgtgtatgaaattctaagatatccttaagaaaatctgaagtatccacgcatctcccttttgccaggcatctgcgtacctcttctgtatccgaaaatcaccagcatttcccacgatctgcgcacgccgctgactgccatctgcggctatctagaacttttggaaaaggaaccgttatctgctgcctccctccagtatgttgccatcatccgggaacgcacggatgtgatgacacaactggcggaagaactgttccggtattcggttgtcctgtctgtgcctttggcacagcccctgcaggaagtgtcggtaaaccgcattttagagggaagcattgccgcaatgtatgcggtgctcaaaagacaccggatcacgccggacattaccatgaccgaccggacttgggctttcattgcacggacactggtggagcagatgcacgggcagatggatgccgcttatgaagcggggaggcttgtcatccggatgcagatttagtttatttttttataaaacagaccaaaaataaagcaactacaacaactcctgtgcctatgatgatacacctctttgctgtggtgacttctttttgatataagcgaaataattctccggaatgattctttctattatggagaccaatcattgcatagatcaaaaagaatgcaactccgaatattaaaattacactcagccgtccccaagcagaaggaatggtgtattgaccgattatgatacatagcaggatcataaaatacacgattttattttgcccatatcctaaaggaagttctttttgataatttctatacatcatttttccataataaacgatcatgcatattaaaaacaatagatagattatcataaccatcatcctcattgtatacctccttaattttgtctcatacgagaaaatgtcacatccgcctccggatcggtaagctctatattgatccgaatgttgcgccgctcatgaagcaataattgttttgctgtctctgtgctgattcccttttctttcttctcattggtctgaacatactgtttccccgatagtatcactattcttttcgaatcgtattgcatatagttacgaaaaatatgaaaattttcagtccggcataataatccggatcagatgtttatccaacatgattgtccggttccagggattgataataatccctgcgatctccggcacagtaagtgctgcttcaaacatcctgccgatctctgacaaaaatgtcgacttcacctgatctgcaccttttaattcttcctcaaagctggtaaatgccgaccaccagattttaccgtccggagtcctcactgtctgtaacttcatttgtgcctgtgccggatccggttccacagcaacgatcagttgtcctccctctttcatccgccgccggatcaccgtcaacgtatgtgcaagctgctcctgtgtggcttctttctgaagcgcaaaaattgcatcttctattctttcattgccctttaatccctcatcctgatattcatttttcttgtccatattttgtatcctctcttgtctgttcattctattataaaatgagtgattcctttttgaaagccatttctttcagattctccttttgggagaattctttcgacagaaccgtccttctctttctctgagacaacgaacctccaactctccaactcatagattgtattctctgcacgtttcttctatactgaaaacagacagatgctgcagcaactgtctcttacgaaggaggttccactatgtcacaaaataagattggtgaatttatacaacaatccagaaaagccaaaggactcacgcagaaagatctcggtgatcagatcggtgtcagtgataaaaccatatccaaatgggaaaacggaaacagcgttcccgacacctcgattttaaacgaactttgtgcttctcttgatatcaatgtcaatgaacttctctccggtgaaaaactaacaccggaaatttattctatgaaagcggaggaaaatatgatgaaccttttggaagacaatcaaaaacaacagcgctttgcactccttccctgtgcagcgggtatcattttattgatccttaccggactgtttgcaatatttacacatatgcttttaccggatatgctggatctttgggattttccaacactcctcatttacatcggaatctgttgctcccttgttttattgagcggaaagcgccataaacaggaaatcattcactttctccggaaaattgtggtacctgtcggatgtatctgtcctctgttggggataaaccagtttattcatcagttccgtgatccggctgatattggttctttcgtaaaccaatgtgtcttatttgttctctattccctaattgcctatgtgattctggttcttatcgaacagcatctggacaaataaaattttatatgtaaaaacagcccctgtacctattggtaagggactgtttttattttatcttacatattcttaaccgttgcaatatccactggagtaagctccccatgagcggtctctaaagaacgtgccagcgcatttgcggtatccatagcggtaatacagtacacaccggtctcgatcgcattacggcggattaagaatccgtctcttgtcttatcaccgttaccctgtgtcggtgtatcgatgacaaggtcgatcttgtggccaaggatcagatccattacatttggtgactcctgcgaaatcttattgacacgcagtgcattgacgccgtgctcctgcagatactttgcagtgcttcgtgttgcgtagattttgtagccgagtgcctcaaaacgctttgccacaccgacagcctccggcttatcggcatcctttaccgtcataatcatctgcttgtatttcggaagctgtacacctgctccaaggaatgctttgtacagcgcctcattgaatgtctttgcgatacccagacactcaccggtagacttcatctccggtccaaggctgatctctgccccacgcagtttctcgaaggagaataccggcatcttgattgcgatatagtctgcaactggtgcaagtcccggctcatagcccagaccgcggatcgtgttaccgatgatcactttggttgccagatctacgatcggaataccggtaaccttactgatgtacggcacggttctggaagaacgcggatttacctcgatgacatatacttcctcgttcatggcgataaactggatattaatcagaccgaccacatgcagtgcctgtgccagacgctttgtatactctacgatggtatcctttaccttatcactgatcgttggagccggatatacggaaatactgtctccggaatggactccggtacgctcgatatgttccataataccaggaatgagaatgtcggttccgtcacatacggcatcgacctcgatctccttaccctgtaaatacttgtctacgagaattggatgatcctgtgcaatacggttgatgattccgatgaactcctcgatttcctcatcgttaaacgcaatcttcattccctgtccgccaagtacataggaaggacggacaagaaccggataaccaagacggtttgcaacttctttggcttcctctgcggtgaatacggttccaccggctgctctcggaatatgagtcttctccagaatctcatcaaaaagctcacgatcctctgcggcatcgacatcctctgccttggttccaagaatcggaacgcccatcttcataagcgcctctgtcagtttgatcgctgtctgtccaccgaactgtaccacagctccgtccggtttctcaatatttacgatggactcgacatcctctgcggtcaacggctcaaaatacagcttgtctgcaatatcaaagtcggtggaaacggtctccggattgttgttgataatgacagtctcccagccttcctttgcaaatgcccaagtacagtgtacggaacagaaatcaaactcgataccctgaccgatacggatcggaccggaaccaagaaccagaacctttttctgcggtgtggtctctgcagcctcgttctcacttccgtaaacactgtagtaatacggtgtctctgcggcgaactctgcggcacaggtatccaccatcttatatgctgcaacgataccgtttgcataacgcatctgtttgatctcttcctcggtctttccggtaagctctgcgataacgttgtccgggaactcgattctctttgcttcttttaacagatctaccgtcagttcttcgctctttaagtgctgctccatctctaccagaattgccagcttatcgataaaccagcggtcgatcttggtaatttcataaatatggtcataggaaacgccgcggcgcagtgcctctgcgatcacccagattctgcggtcatcgaccacatgaagctgtgcctccaacgcttcatcggacagtccggtaaaatcataggacataaggctgtccacatgctgttccagggaacggatggctttcatcagtgcgccctcgaagttatcacagatactcataacctctccggttgctttcatctgtgtacttaacgttctctttgcagtgaggaatttatcaaacggaagtctcgggatcttaactacacagtagtcaagcatcggctcgaaacttgcataggtcttctgtgtgatggcgttcttgatctcatcaagtgtatagcctaatgcaatctttgcggtaacctttgcaatcgggtatccggttgccttggaggcaagagcggaagaacgggatacacgagggtttacctcgatgacacagtactcaaaagaatccggattcaatgcatactgcacgttacatccaccggtgatctttaactcattgataatatttaatgcagaactacgaagcatctggtactctttatctccgagcgtctgggaaggtgccactacaatggaatctccggtatgcacaccaaccggatcaatgttttccatgttacatacggtgatgcagtttccgttcgcatcacgcattacttcgtactcgacttccttccatcctgcgatacagcgctcaaccagtacctcaccgacacggcttaaacggagtccgttgcttaagatatcgaccagctcctgctcattgtgggcgataccgccgccacttccgccgagggtgaatgccggacggagcacaaccggatatccgatcgtattagtaaacttgataccgtcttctacggtatttacaacctgggaagctgcacaaggctcaccaatcttttccatggtatccttaaatgcctgacggtcctctgccttaaagatggtttctgcggtcgtaccgatcagttttactccgtgctcttctaagaagccggactctgccagttccatacccagatttaatccagcctgtccaccgagtgtcggaaggatgctgtccggtttttcctttaaaataattttttcaagaaccggaagtgtcagaggctcaatgtatacctgatccgcaatctgcttgtcggtcatgatggtggcagggttggagtttaccagacacacctccacgccttcttcctttaaggaacggcatgcctgtgttcctgcgtagtcaaactcggctgcctgtccgatgacgattggtcccgaaccgattactaatacttttttgatatctttatttcttggcattactgattccctcccatcatctgaataaagcggtcaaacaggtacgaagagtcctgtggtcccgggcatgcttccggatggaactgcacggtgaaaatattctttccgacatattccaaaccttcgttggttccgtcattgacattgacgaatgcaggctttgcaaccttcggatcaagggtatcggtatctaccacatacccatggttctgggaagaaatgtaaacacggccggttgataaatctttcaccggatggtttccaccacggtgtccgtatttcatcttgtgtgtatccgctccgtttgccagtgccatgagctgatgaccgagacagatggcaaagatcggtacgtcacttgcatacagtttctttaattcctcgatgatcgctgtgcactctttcggatctccaggtccgttgctgagcataatgccatccggattggctccgagaatttcctccgccgatgtgtgtgccggataaatcgtcacctcacagccacgggcatttaacgattttgcgatattgttcttcgcaccgaaatccatcagtgcaactttctttccgcttccctttaatacgttcttctcgctgcaggtaactttatccacaacatttccggttgtatattctttcagttttggaagaatttcatccagattataattttcgtttgtcgtgatcattccgttcatggttcccttttcacggagaatcttggtaagcgcacgggtatcaattcctgcaattcccggaatgtcgtgctttgtcaggaaatcctgaatgcttccctgacagcggaaattgctcggcatacgtgaaagctctcttacaatatatccgtccggccacggtctggcggattccatatccggtgtaattccgtagtttccgatcagcggatacgtcatcacaaccgcctgtcctgcataggacggatctgtaagtacctctaaatatccggtcattgaggtattaaatacgatctcactgatgatttcgcgtgtagaaccaatgcttgtacctgtaaacacggttccgtcttccagtatcaaaaaagctttcattctttgccctgcctttcttgcatcttggcaaaaaaaaagagagaatctcttttttttaccttgagttagctttacctaaattgtaaaaattttatcacaaatcgtcacttttttcaaccttttttgcaagagaaaaaagtgacatattttatgaataaatatacatattatacaattccatgcatccacaataccatgaacccgacagcaactgccgcacagactgccagaccgccaatgctggttccgaggatcacgccggatggaatttctttcttttcatatatcgcgcgtgccacggtttttgcctgcatcggaacaaatgaacacggctgtgttacctccattggatgaaaccggcgtttggtaaaataatccgctgtccatgccggcattgccgataacgtcaccctctgtaactgatattgatttgccgcatacgccttcatttcttccaacagacatctgccacatcctctgcgctggaataccggaagcacatacagcatggtaatatgtccctctttctgcattcctgacatggcgatcatatgtccctgttcaaaaattccccacatggtgagagttccttctgcaatcatgttccggatgtttgtgttttccgtatattgcagaaatatatgaatcatttccagatccgtgatccgcgcacgcagacagtaatcaaagacaccccttgcaatactgagcgcttccggaatctgatcttccgttaaaatctgtgctttcatttacgcttcctccttgttttccaacagccggtccttcagaccgctgtaacgtctctgttgggaattattctcaatcatttgttcaaatgttgtatcatctcctactatcgtaacacatttctttgctcttgtaaccgctgtgtacaataaattccggttcataagcatgcgggggccggaaagaagcggaatgacaacggccggatactccgatccctgtgatttatggatcgtcacagcatacgcaagttccagctcatccagcagtttgtacgaatattccaccatacgcccttcatcaaaatttaccgtgatggtctctgcaaaatcattgatctcttcaataattccggtatctccgttaaacaccccggttcctttgtctatgcagagtccatatttgctgcggatctcccattccagctgataattatttttgatctgcatgactttatcgccttcccggaaaacgatcgccccatgctctttctccttttttctgtccgatggcggattcagatacatctgcagaatcgtattgagacgttctactccgagcagccctttccgcataggcgtaagcacctggatatcgtattcgcttgcccccacaaatttcggaagtttctgcttgatcagctgcagcgtaacgttgataattttatctgcctcataacgcttcaggaaaaagaaatccatgctcttattatccaggctgactttttctccccggttaatcttatgcgcattgacaataatatcactggtgcttgcctgtcggaaaatttttgtcagcattaccgtaggaaacatcttcgaatcaataatgtccttcagcacacttcccgcccctacactcggcagctgattcacatctcccaccaggatcagacgcgtgcccggcaaaattgctttcagcagggaattcatcagggaaatatccaccatcgacatctcatcaataatgatgagattggtctccagcggattttgttcattgcgctcaaatccggcatttccttccattccgccattcagttcgagcatccggtgaatcgtccgtgcctcatacccggtggtttcgctcatgcgctttgctgcccgtccggtcggtgccgccagcataatatcttctccggataattcaaaataccggatgatcgtattgatcgtcgttgtttttcccgttccgggacctccggtaatcacgagaacaccgtttcttacggcttcctttaccgcttctacctgatgctcatcaagatccattcccgtcttcttttcaatctttcggattctgtcctcaatttcgatatccggaacatcaaacacagcattcagctgtgtcagacgggtagcggtatttgcctccatataaaaataggttgccgcatagatctgcgtactgtcttccacctggcgcataatgatcttgcgatccatcgccagattcatgtaatgctgctcgatgtgctccgggtctacctcaagaagccggcttgcccgctgcgtcagttcctgcatcggcagataggtatgcccctctccggcagcctgcagcaacacatactggataccgcttcgaatccggaaatcggaatcggtgcggattcccacacgagatgcgatctcatctgccgtgcggaatccgaccccttccacatcatctgccatacgatatggattttctttcagtattccgtatatttcctgcccgtatgttttatatattttcactgcaagtgtggtattgatcccgtattgctgcaaaaaaatcattgcctgccggagatcttttttctgattcacctgatccgcgatttccatcgcctttctctggctgatgcctttgatctccgccagccgctccggttcttcttcaatgatacggaaggtatctgccttgaatcttcgcacaatccttgccgctaaggcaattccgatccctttgatcgcccctgatcccagataccgctcaattgccacctcatcctgtggtgccttttcttcgaaactctttacctgaaactgtctgccgtaagtcggatgttctgtataacttccctttgccttaatgttttctccctcggcaatatccgaaaatacccccacacaagtctcttcttcttcgttacacaccagaacaagtacggtatatccgttgtctgcatttcgatagatgatgtgatctacatatccttcaatgctctcaagattctcttccaaaatatgttccccattctctaaaaaagagactgttgtaaacagtctctcctcttttctttgtgctgatgttactactggccaatattacgtttcatctgctcatacagtgtctgtgtatagctttctccgatctgatccaccatttcatctgccaccgtttcaattgcctgatccatatacagatctttgtactgtgacatcgtagaatccccgtcatcatccgaggtaaatgtatctttcatctgtttgatgacctgctccacaaaataagattcaaaatctttgatgacaccttttaattgttcctctgaagagtccgatgaaatattctttaatgaactctgaagagaattgctctgctctgcacttttgtctgcatttgcaaccgtataatttgtactgattgatgaaatatccatagtatatccctcttatgtaagtaattccgaatcgctgcctatcgtttcaggttatttgccgtctccagcatggaatccgaggtcgtgattgccttggaatttaattcatatgcgcgctgtgcaatgatcatatttaccatctcatcagcaacctgtacatttgaagcttcgatgtagccctgatatacaccggtcttcgtcaatcctgcattttgtccctccagcatcggatttcccgaagctgcagtcgctgcaagtttacttcctgacattttctccagtcctgccggattgttaaactgatagattccaaaagactggtttaatgacactacattgccggttgcatctttatagccaatcgttccattgctcgaaaataccatgctttccgaagatacgcctcttggcacacgaatggtatttcctctggaatccaataccggaagcccctctgaggttgccagaattgtgtttccattcgaatcctgactccaggagaagttaccgtttctggtgtaatatgtctgtccatccacaccccgcacggcaaagaatccctttccttccagtgcaaaatcggtcggaatctctgtctcttcacgcgccccctgcgtatagttggacatggtcgctgccactctggttccgagtcctacctgtgcacctaccggtttattggcaccatttgccgtcgttgtctttgtctgcagtgtctggtacagtaaagatttaaactcggtacgttccgtcttataacctgtcgtattcacattggacaggttatttgaaattgtatccagatttgtctgctgcgcaatcattccggttgccgcagtataaagtgatctcatcatacgcttctatttcctccttgcggtctttcagcgactattatactttaccgacattgttaactgcccggtcaagtgttccatctatggaagtgattaccttctgtcctgcctcataggctctctgaattgtaatcatatttaccatctcatttacaacatttacattggaagtctccagtgtgccctgctctatattggcatctgttgcaatccggtttcctcccggaagaaggttatacagattctcaccgtatttttcaagatagtcataattatccacatccaccatgccgatcgttccgacaatctggttattctgcatgacgtatcccagtttattcacggtaatcgcagcatttggatccagacgtatataattattctgacccggatcgccattcattgcaccagtggcatttaaaacataatcgccatccttcgtcaccagataaccctctttatttacggtaaaggctccatcccgcgtatacttcacggaagtatttccctgcttgtccgtgaatgccacggcaaaaaagccgtttccttcaatcgcaaaatctgtggtgttatctgtcaccttgaaatttcccgtggaataatcggtatatacctgtccaaggtgaaccccatatgtaatatctccaagctttttcggaatccccatgttagaagaatccttaatgcgcaaagacatctcatcggcaaaagtacgactcgtcgttccttcttttttatatgctgttgtgtctgcgtttgccagattatttgccagaatatccagacgcttcatttcgtttaccattcccgtatgggcggtatacaatccttttaccatttatgacacctcaattttcacagttttaatttatatcggcaaatgccctcacgagctttatagacatgcgataaaaagtgcgcataaacgcgcactttatgcattaatcctcgtctctttttcctgcaaggaattctacatattttccggttccgattgctacacaggtcataggatgctctgccgtcatcgtgttgattccggtacgttcttcaatcagttcctccagaccgcgaagcaaggagccgccacctgtcaggacaattcccctgtctgcaacgtctgctgccagttccggtggagttttctccagtacggaatgtacagcttccacaatctgtaatgttgcctcacgcagagcttcctctgtctcctcagagcttaccgtaatggttcttggcagaccggttaccagattacggccacggacatccatcgtctcattctgtgccagtgggtagcatgtaccaattttgatcttgatatcttctgcggtacgctcaccgatcaaaagattatgtttctttctcatatagcggaccagggcttcgtcaaaatcatctcctgcaattttcacggaagtgctcacaacagaaccacccagagaaatgactgcgatatccgaagtacctcctccgatatctacgatcatgtttccgcatggtctggaaatatcaataccggcaccgattgctgctgcaattggttcctcaataatctctacttcgcgggctcctgcctgataagttgcatcctctacggctttcttttcaacctctgtaacaccactcggtacgcagacgctgatgcgcggcttacgaaagctcttctttccaagtgccttctggatgaaatacttgatcatcttctctgtgacggtataatctgaaatcacaccctggcgaagaggacggactgccacaatgtttcccggtgttcttccaagcatcagccttgcttcctcaccgattgctttaattttattggtatctctgtcaaatgcaacaacggaaggctcttttaatacaacaccttttcctttaatatatactaaaatactcgcagtacctaaatcaattccgatatctgatccgatcatcccgaatgccccttcctattttctttttatctttctttatcaaaatccgatctgcgtttatggcgcaaatctgcagttaatcatatttttatgcatacagtaacattatatacaattcatcccatttttcaaacatttttttataggttaaagcattttaattaaattttaaggaatctctctgttcccaggacaaaaatctgtgcattttcgctattttatacgttcttcgattccagatacggttttaaaaactgaccggtatacgattccggaactttgcagatttcctccggagtcccctgtgcaatcacggttccaccaccgtcaccaccttccggtcccatatcaatgatatagtcagccgtcttgatgacgtccagattatgctcgatgacgacaacggtatttccgccgtccgaaagctttctgagaatctccaccagcttgtgtacatccgcaaaatgcagtccggtggttggctcatccagtacataaatggtttttcccgttcctcgtttgctcagttctgtggcaagtttgatacgctgcgcttctcctccggataattctgtggaaggctgtcccagttttacataggaaagtccgacatcgtacagtgtctgaatctttcggtggatcgttggtacatttttgaaaaattccaatgcctcttccaccgtcatatccagcacgtcatagatcgtctttcctttatagcgcacttcaagtgtctcgcggttatagcgcctgccaccgcagacttcacacggcacatacacatccggcaggaaatgcatctcgatctttatgataccatctccgctgcaggcctcacagcgtccgcctttgacgttgaaactgaaacgtcccttcttatatccacgtgcctttgcatccggagttgccgcaaacagatcacggatcatgtcaaacaccccggtataggttgccggattcgaacgcggtgtgcgtccgatcggtgactgatcaatatcgataatcttatccagttgttccacacccagaatatcatcgtgatctccggggatgcagcgtgcccggtttaaagttcgcgccagatgcttatacagaatttcattggtcagggaactctttcccgatcccgatactccggtgatacaggtcatgataccaagcggaacctgcacatcaatatttttcagattattttcccgcgctcctttgatggtaagaaatccggtcggtctgcgccgttccgatggtaccggaatcttcatccggccgctcagataagcgccggtaatggattttttgcatttcatgatatccgccgcagtaccggccgcaacgacttctccaccatggacaccggctgccggaccaatatccacaatgtagtcggccgcacgcatggtatcctcatcatgttccacgacaatcagcgtatttcccagattcttaagattcatcagtgcatgcagcagcttgtcattgtcccgctgatgcagtccgatactcggctcatccagaatatatgccacgccgaccagtcctgaaccgatctgggtagccaggcggatgcgctgcgcctctcctccggacaaggttccggtcgcacgtgtcaatgtcagataatccagacctacctcctgcaaaaagcccacacgggcacggatttcctttaaaatctgattgccgatgaactgctgctgttccgtcagctgcatttccgccagatatttcacgagatcctttaccgacatatcggtcatctcatatatatttttgtctgcaaccgtaaccgcaagagaactctgcttcagacgctgtccatggcaggcagcacacggtgtaatacgcataaactgctcatattcctgcttcatcgtgtccgatcccgtctcccggtaacggcgctcgacatttttaataaggccttcccagttcagatcatagacgccttctccacgctgtcctttataatgcacctttaatatccggccatctccgccatgaatgagcatatgccggatttcttttggcagatctttatatggtgtatcgagagaaaatccatatccttccgacaacgcttttagggtagcataggtatagctggacggatcggtgcaggactgccagcccattacctgaattgccccctcggaaatagacagtgtcttatccggaatcatgagattttcatcaaactccatcttgtaaccgagtccgtagcagaccggacaggcaccaaacggattattaaacgaaaagcttcgcggttccacctcatccacactgattccgcaatccgggcacgcaaaattctgggaaaaattcattggttccccgtccaccacatctacaatcgcatttccctcggtcagctcaaaaacattttccagggaatcggtcagacgcttttcaattccgggttttaccaccagacggtctaccacaatatcaatattgtgtttgatgtttttatccatcggaatttcttccgaaagttcatacatatttccgtccacgatcacacgcacataaccgcttttttttgctttctcgaataatttctgatgttcgcccttacgcccgcgcacaaccggcgcaaggatctggatgcgtgtgcgttccggcagtttcatcacggcatctaccatctgatcgatcgtctgtttctcgatggcacgtccacacttcggacaatgtggaattcctatgcgggcatacagcagtcgaaaataatcataaatttccgtcacggttccgacggtggaacgcgggtttcggttcgtcgatttctggtcaatggagattgccggcggaagtccctcaattgactctacatccggtttttccatctgtcctaagaactgtctcgcataggaagacaaagactccatatagcgccgctgtccctccgcatagatcgtatcgaacgcaagcgaagacttgccggaacctgacagtccggtcagaacaacaaactcatctctcggaatgtccacatcgatgcattttaagttgtgttcgttggcgcctcgtattttaatatattttctctgttttttcggcattttgtttcctctcttttatctattcctcaatatcccgaagcatatttttcagttttaccatcttgtcacgatactctgccgccgcctcaaaattgagttctgcggcagctttcttcatcttcttctggatgtccccgatcagtttttctaattccctgcggctcatggattccggatctttatcaaattccatctcctctgctgccacttttttggagattgcaatcagatcacgcacagatttctggatggtcttcggtgtgattccatgttcctcattgtatgcctgctgaagcttgcggcggcgctccgtctcatcaatggccacacgcatggaatccgtgatcttatccgcatacatgattacatgtccctcactgtttcttgccgcacgtccgatggtctggatcagtgaagtctcggaacgaaggaatccttccttatccgcatccagaatcgccacaagcgtaatctccggaatatccaatccctcccgcagcaggttgataccgacaagtacatcaaacacgtccagacgcaggtcacggataatctctgcacgctctaaggtatcaatatccgagtgcagatattttacacggatgccaagttcgctcatatactgtgtcagatcctccgccatacgcttggtcagtgtcgtgatcagcactttatggtgatttttcgtctctttgttaacttccccgatcagatcatcgatctgcccctcaaccggtcgcacggaaatctccgggtccagaagtccggtcggacggataatctgctccacacgcagcaattcatgctcgttctcatagacattcggcgtagctgatacaaacagcatctgatcaatcttgctctcaaactcttcaaaattaagcgggcggttatcgagtgcggacggcagacggaatccatagtccaccagtgtctgcttccgtgagcgatcccctgcatacattccacgcacctgtggaatcgtaatgtgggactcatccacaataatcagaaagtcgtccggaaaataatccatcagtgtctccggcatttctccctcggcacgtcctgccagatggcgggaatagttttcgatgccgctgcaaaatccggtttccttcatcatttcaatatcaaaattcgtgcgctccgcgatacgctgcgcttccagcagcttatcttcacccttaaaatacctgaccctctcttccagttctgcctcgatacggtcacacgctgcgttcattttttcctgtggcaccacataatgggacgccggaaacacagccgcatgctttaatatacatttgatctctccggtaagcacatccacctccgtaatccggtcgatctcatccccgaaaaactccacacggatcgccgtgtcggtattattcgccggaaaaatctccagtacatcgccatgcacccggaacgtaccacgcttaaaatccatctcgttgcgcgtgtactgcatgtcaatgagtcccttgatcacatcatcacggtcaatctccattccaggacgcagggaaaccatcatgttcatatagtcatccggactaccaatgccatagatacaggagacagatgccacgatgatgacatcttttcgctccgccagcgctgccgtggcagaaaggcgcagcttatcaatctcatcatttaccgcggaatccttcgctatataagtgtccgactgcggcacatacgcttccggctgataataatcatagtaggaaacaaaatactcgacggcattctccgggaaaaattctttcatttctccgtacagctgccccgccagtgtcttgttgtgggaaataatcagcgttggcttattcagtgcctgaatgacatttgccatcgtaaaggtctttcccgaaccggtcacacccagcagtgtttcaaactggttgccttctttgaatcctttgactaatttttcaattgcctgcggctggtcaccggttggctcatatggggcatgtaatttgaactccataatgccctctcccttctcaaatttatcgtaaaattaactttattccatgaaaaaaaagataaaatccatatctttatagtctgcacatatatgctaattttactacaaagatctgactttgtctatctcaatcagaacatttgttctcatctttctttttgcctgtaaagtgtgtatgataacagcaaatacatgtcacaaaagataaggagattttgtatgaaaagaagaaaagaatttcatttatttccccttggaatattgttatttgccctgacattaaccatagtttcaggccggattgctatccatgcggcagatctgaatacagaactgcccgcaaatgactccacggaaatttcttccgaaattccaacggaaacaccggtggttccttccacggaaaatcccaaaccggtattgcagggacttatccatgataaaaacggacatttctatttttatcagaacggaaaaaagctgaaaaaccggtggaaaaaggttggcaaaaacaaatactatttcgggaaaaacggacaggcagttaccgggaaaaagaatatttcccattacttatgttactttaataaaaaaggggttctgacacggaaaatcgataaaaacaaaaagatggttgccctcacttacgatgacggaccatcggtttataccccaactattttaaaaaccctgaagaaaaatgattccgttgccacattttttgtggtgggcagccgcgtatcgacttactccaaaaccgtacagaaggcttatgacaacgggtgtcagattggcaatcacacttatgatcacaaaattctgacccgggttgggaaaaaggaagttcaaaaacaggtttccaaaaccaatcgtgccgtcaaaaaagtaatcggtataaatccggttgtgatgcgcccaccgggaggtgccaccagttccaacatcaaatcatgggtgggaatgccttccatcatctggtccatcgataccttagattggaaaacgcgggattccgcaagtacccagaaagccgtattgaaccatgtaaaggatggagatatcgtactgatgcacgatctgtataaagcgaccgccactgcctcccagacaatcattccggaacttaccagacgcggatatcagctcgtcactgtcagcgaacttgcagagtgccggggcggcatgaaacagaacaaatcttattctaaatttccaaagaaacaaaaatagtgtcattacaaaaaaacgcggaaaccatgatggtttccacgtttttgttatctgcttcgattttatacaaccttacgtccgcagcactgcttatatttcttaccactgccacatggacacggatcattcggatataccttggcatgttcacgcttcttcggtgcttttgccgcactctcgtccttattggttccggttacttttgcgacctgctcacgctctaccttctgctctacctgtacatgatagagaagacgaatggtatcctcctgaatacccgcgatcatttcatcgaacatatcaaatccagccatcttatactcaaccagcggatctctctgtccgtatgcctgtaatccgataccctgacggagctgatccatatcgtcgatatgatccatccacttgcggtcgatcaccttcagcaatacgacacgctccagctcacggaactgctcgatctccgggaattcggtctctttagcttcatataaaagcactgcctgttctttcagatgctgctttaattctttgacatccttgatatcttcgatatttttctctgtaacaggttcaagaggaatcaccggcagaagaatttcatttaattcatttaaattccactcttcgcgcggaatctcattcgaaatacaggtatcgactgatttctccacctgttcctgaatcatcttaaaaatcgcatcacgcatgctgtctccatttaatactgacatacgctctttgtaaatgatctctctctgatcgttgtttacctgatcatactctaacagattcttacgaataccatagttgttgtactcgatcttttcctgtgccttctcgatggcagaagtaagcatcttgtgctgaatctgctcaccttccggaacaccaagtgcgttaaatactgacatcagacgctcggaaccgaacagtctcatcagatcatcttccagagaaataaagaactgggattcacccggatctccctgacgtccggcacgaccacgcagctgattatcgatacggcgggattcatgacgctcggtaccgatgatctttaaacctccggcttcacgtgcatcctcgtccagcttgatatcggtaccacgtccagccatgttcgtagcaatagtaaccgctccgtgctgtcctgcctgtgcaacgatctcggcctcctgctcatggaattttgcattcaatacggtatgcggaattccctcacgctttaacattccgctgatcagctcggaagtctcaatcgtgatggtaccaaccagaaccggctgtcccttctcatgtgcttccttgacttcctcaacaactgctttgaatttttctttcttcgtcttatataccgcatcctgatgatcgatacgtgcaatcggacggttggtaggaatctcaataacgtccatgccgtaaatatcacggaactctttttcctccgtcagagccgtaccggtcataccggctttcttctcaaatttattgaagaagttctggaatgtaatggttgcaagtgtcttgctctctctcttaacctttacatgctcctttgcctcgattgcctgatgcagaccatcggaataacggcggcccggcatgatacgtccggtaaactcgtcaacgatcataacctgatcatcttttaccacgtaatcctgatcgcggaacatcagataatgtgcacggagcgcaaggatcacattatgctggatctccaggttctccggatctgccaggttatcaatatggaaaaatttctcaaccttttccacaccctgctgtgtcagattcaccagtttgtccttttcatttacgataaagtctccggtttcttcctgctcaattcccatgatggcatccatcttggaatactccggtacatcctcaccacgtgtcagctgctgcgctaaaatatcacatgcttcatataatttggtggacttgccactctgaccggaaataataagaggtgtacgcgcctcatcgatcaatacggaatcgacctcatcgatgatcgcatagtgcaggcctctttgtaccagctgctccttgtagatcaccatgttgtcacgcaggtaatcaaatccaagttcgttatttgtaatatatgtaatatcgcaattgtaagcgtcgcggcgctcatcgttgctcatatcattcaatacaacaccaacggtcagtccgaggaattcatgcacttttcccatccactcggaatctcgttttgccagataatcattgaccgtgacgatatatacccctttgccctccagcgcattcagataagccggaagtgtagataccagtgtcttaccttcacctgtcttcatctctgcaatacgtccctgatgcaggataataccaccgataatctgtactctgtaatgctccatgccaagcacacggcttgctgcctcacgtacggtcgcatacgcttccggaagcagatcgtcaagtgtctctcctttttccagacgctccttatattcttttgtctttccccgtaattcttcatccgaaagtgccttcatctcgtcacgataagattccactttatctacgaggggcgtaattcgtttcaactccctgtcactgtgtgtaccaaaaattttagtcaatgcactcataatatattttgctcctaactcgcatagaatataggtattgtaccactttctccacatttacacaactcaaaggccatgaatgttttataaactttttatgaacgaacaggattctgctattgaaaatttgtaaacagcttgctatgataagaggacgattattgtattccaaacacaaggaagaaacagaaaggaaggtaacaacccatgtcttatatttacaaaacaaaaggcacctgttccacacagatcgaagtggagctggacggaaatattgttaaaaatgttaaattcaccggcggctgtcagggaaatcttcaggcaattccccgtctggttgagggcatgactgttaaagaagtggaacgccgtatttccggtattcactgtggcatgaaaaacacctcctgtggtgatcagcttgcccgggcattgcgcgaagcctatgatgcacaaaaaaatgcataataccattcccggattatgtaaaagcctccccagacagatctgtctgggggcttttttatccccgtaccaccggctgcagctgctttccttccaaagctgccgaaatcgtctccggcaaaagttccatttttgccaccattgaatttggctttttttcataattatcctgtgcgaatggcacaaaataaatatgtttcgtattcatcagcatcccgatatttttaaaactggctcccagtgcatcgttggtggatatggcaattaccagtggtttgccattgcgcatatgcgctttggcagccatcagaaccggagtatcggtgattgcattcgccagcttcgccgcagaatttcctgtacacggtgcaatcaccatcacatccagatatcccttcggtccgatcggttctgcctcctgaagtgtgcggattccagggttccccgttatgtcacagacttcttccataaactcttttgccgttccaaaccgcgtatcgcagttctgcgtctgataagaaaagatgggaatcacatgtgctcccatctccgtcagtctctgaatctctttcctagtttttgcgaatgtacagaaagaaccggtaatcccataccctatattgcgatttgataaatccatgtctttgcctctttcctgtcctgcctgattttactgtgttcaagaattgcatctgccagcactttggcactgctctttgtcgtatacagccccggaagtcccaatgccgccacaactttgattccatatgcctccgctgccatcagatccgtaccgccgggtcttgatgcaatatcaatgatcacggcatccgaatgcatttcacggatcatcggctcacggatcacaagtgccggaaccgtgtttacaaccgtgcgtgccccatatgcttcctccggtccgtatgaaaaatcgactgcctcatgtccttccgttcgtgccagccggcgtgcctctgcactccttgccagcactgtcactttcgctcccatcgcagacaaaaccctggcgatctccctgccgcatcttccatacccgctgacaataattttctgctcccgaatagaataatcactgtattttagaatttcagcaaccgttgcttctgccgtaatacatgcgttgcggtgcacaaccaccgcatctgtcatcatatcataatattccgttcccgcatcctcacagcgctgcctccattccggtccgaaaattcctccaaacagcatccagtccctttctttttccctcgtcagttcctcctttaatataaggtttacatcatggtttctctcaatctttgtaacaggaaccggcagcacaagatacctgctgttatccagcactttcagcgcctcttccttttccactccccgtctccagtccagtcggtgtatctttcccggaagacatgcagcaagattgctttgtcgctgatccgtaacaaaaatcacgatatttccggtcatataaaaacgctcccttccatataacatatgaaagggagcgtcataaggtgcaagatcgttcttactaaagcctggtttctacaaagatatcatagatcgccttgatggctgcctcgaaatcgtcattgctgacaccaataataatatttaactcggaagatccctggtcaatcatcttgacattgatgttcgcatgggccagtgcagaaaagattctgcctgcagtaccgcgggtagatttcattccacgtcccacaaccgcgatcagacccagatccgcttccagatcaatcacatccggatgggtcagacggcggatggagctgatcacctgctgctccttgccttcaaactcttcctgatgcacaaatacggtcatggtgtcaataccagatggcatatgctcgatcgaaattccgttttcctcaaatgcctgtaatgctttacgacagaagccaacttcggaattcatcatatctttgtcaatgcttactgcgacaaatccttttttaccggcaataccggtaatcgtgtattccggtttctggcaggtactctctacgatcagggttccctctgcctccggatcattggtattgcggatattgatcggaataccggcctttcgtaccgggaataccgcgtcctcatgaagtacggaagctcccatataagaaagctctcttaattcgcggtatgtgatcacatgaatcggctgcggattgtcaatgatacgcggatctgctacgagacatccggatacatctgtccagttctcatataaacttgcatgacatgcttttgcaacaatggacccggtaatatccgaaccgccgcgggagaatgttttcacccttccgtcagcaccaattccataaaatcccggaatgacagctttttcacattcagaaagcttcttcgccagaaccttgtcggtcttgtctgcatccagatttccttcttcatcaaaaaagattacggttgcagaatcgataaactcatatccaagataatctgccataagaataccattcagatactctccgcgggaagccgcataatccacaccggctttttccttaaagtttttggaaattgtcttaaactcctcatccagcgttactttcagtccaagtccgttgataatggaatcataacgctctttgatcttcatgagaggaacacggaactcctcgcctgcctctgctttcgcgtagcatgcatataacatatccgtaaccttggtatctctggaattacgctttccaggagcactcggcactacatattttctggattcatccgcacggataatatcgccaaccttggcaaactgctcggcactcgccagcgagctgccaccaaattttacaaccttaaccatttttaacttttctccttcaagaataataacttctgctattatacttctaccgtctggctttcgtcaattattttcttccagatagatcacatccgttgcgatcgtattgcttgatccgtccacctgcagaatcccgtatgatggcggtattccgtaaggtggctgtccgatgcttcccggattcatataggcgatccggttgtgtttgtcataaaaaacccggtgggtatgcccgaacagtgcagcatcaactttccgctcctctgccgcatattccagattcagatatccggcttttacattaaatgtatgcccatggcagatcagtattttttttccttcgatcagtagaatccgttccgggatgtcctgacggcaatcacagtttcccggcacctgttccattatcgtcataggaaatttccggtgcagctgttctgcatccgcccagcagtcccccagatgaatgatgatgtccggctgtaaccggctgactgccgtgaccatattatttacatttccgtgcgaatcactgagtaccagaattttcttcatataaagcatactccttttcgtttaaaaagcaaaaagacctttgctccggcatcctcgccaaggcaaaagtcttatctccttctcatttcagcgatgactatcccagtcgcttccactgcttactacatttgtagtaggaataaaacatgcagtgttccgcctgctcgcagcgctttggtgcagtctcaatgctgcactggcaatttacaattgcatctgccttccccttacaatttccctttaacatgacatcgtctaaaacttcatctgacatacttctttttgctccttattactaccaagttttgttcacgacgatcttcattatacaatatatggtaggtaaagaccataggtcaaatctcacaaatagacctgcctgttttataaaaattttcacttgacgaaacagggaaaatgcgctagagctccagcttatttattaagttcaaattatacttttccaccaattccatgcattttctgtaagaatccatatcctgaatatgtctcacacaatgggcatccaatccgagaatcgctttatttccgacttccccggcaatcttccagaaacgctctgccggataatgccttgccccttctcccatgccgagcatgttgatctccaacggaatgtccagttccttcatttctttgcacaaccgggtcatctcccagtcatataccgaatccattccctgataattcatcagatccggatgggcaagatacgcataacttccggtctgcatcccttcgattacaagatccacatatctgcggatacggctttcatcctccgtctctgtcccggtatacggtccgttttcttccgatcccaggaaatgctgccccatgatcatataatcacatccgagattgcggaacatccgcatctgttcttcgtaaaattccggaacatactctgcctcaaatcctgcatatatttttatctgatcccggtactccgcttcgagccttcggatcgtctccacatattccggtgcctgtttcatggtcatccggatattggatacatatccgtcctgataggggcacggcacatgatcggaaaatccaaaaatttcaattcccatggaaatcgctgcctcaatatattctctctccgtatcataggcatgctggcaccgccatgtatgtgcatgataatttgcttttaaaaattccattctgttgtccttcatccgtttattcgcctatcattttaacatggaatacgttttatgacaacaaaagaccgtgtgcatcctctcatgcccacacggtcttttattatttcaaatacccaaataaattactccctattgtttaaatgaacaatatttctattttttttttcgacaaagaacatatataagcgcaacgaaagcaaaaagagcagttgccattatatgtcggctatttgattgtggaatttttatgaacatacaaaaaagtgttacaatcagtgctgggatttctatgattgataaaataataatagatggtaaaaaatctttttctccgccctttttcatatcaattcctaacacagctacaatacaaagaggaattatttctgacattaattccaaaccataattcatatgcaatctccttatttttcttaatgtccccaccgcctagaccaagaaacattttttttcaaaagaactttttcagaagaatcagaataatttagtctgcacaaccttttgtaagttgcaactaacattagtttaccacaattatcaaatatgtcaatgatttcttcagattttatcaaatattaattaaatattaaatacatttttatatcattttctattacaaattcacatcatatattgtattactttaatcatggaacatctgctgttccatgataacgttctcctgatttttcgtactttccgatccactgtgctctgttttcataaaaaacagtgctcctgcaaggaaaagaaatacgatcgcggataccccgatgtttatactcccaaaagcctgggaagtcagtccgaccaccgtcgttcccataaaggatgctccttttccgcagatatccatcagaccaaaatactctccggaacgctccggcggaacaatttttgcaaaataagaccgggacagtgcctgaatacccccctggaacattcccacaaagattgccagcacccagaactgccactgtgccttcataaacacggcaaaaacagtaatccccatatacgcagctatacaggttaaaatcagctttccggtatcgtatttttccgcaagcctgccaaacagaatggaaaacggaaatgcaacaaactgtgtcacaagcaatgcaagaagcagtcctgtggaatccagccccagggcagaaccatacgccgttgccatatctataatcgtataaactccatcaatgaaaaagaagaatgctatgagaaacagaaagattttcttttgtttccgtacactgcgcagcgtttctatgatacgtccaacgctttccctcatggcatgcggtttccgctctacataatgaacctggcgatactgcttcattaaaggaagcgacatcacaagccaccacaccgcaaccacggcaaacgcaatcatcattcctgtttcaaaagaaaatcccattttctgatacccaagtacaaaaacaagacttacgatgaaaggaatacagcttcctgcatttgtgggtggtgcatgtataaaatgtaggtaaaatatatataatttgaccttttcccaaacgtagcatataataggaaaaaccaatggacatgtatgattcttggggggatatccatgattacaatgttagcgaaaatctttatcaaaaaccgtccggcaaaagaacaacggcaggcatatggcaccctgtgcagtatcgttggaatctgcttaaatgtctgcctgtttgccggaaaatattttgccggaatgttaagcggttccgttgccatcacagcggatgcgttcaacaacctgtccgatgccggttcctcttttattacacttgccggatttctttatgccgggaaaactccggattcggagcacccattcggacatgggaggtttgaatatgtgtcgggatttgttgtagcgattgctatcctgatgatgggatttgagcttttaaaaacttccttttccaaaattctgcatccggaagccgtagacacaagtctgcttgccatgggaattctggtatgctccattctggtaaaaatctacatgtactgttacaaccattatattgggaaaaaactcgattcggatgccatgcaggcgaccgccatggattcgctttccgacaccattgccacctctgtggttctggcagccatgattattatgcgcctgacatccatcaatgtcgatggatttggcggtctgctggtagccattttcatcctctatgccggaataaaagcggtcaaagacaccatggatccgcttctcggaaaagctccggaccagacatttgtccgggaaatccgtgccattgtcatgtcccatcccaaagtacacggtatccatgatctgattgttcatgactacggtcccggccgccgcatgatcaccctgcatctggaagttccgggggatgaagatgtctttcagctccatgacatgatcgatcacattgaacgggagctggatcagaaactcggatgtgaagccgtcatccacatggatccgattgaaaccaataatgccgcaattgcccagatgcagcagcaggtagaacaaaaggttcttgaaattgaccgccgtattaccatccacgatttccgcctgatcaactgcgatacctacaccagcattgcctttgacgcggtcatcccctatggtatgcgaatccgtccggaagacctgaagaaaaaaattgaaaacaagcttcaggaaatcgaaggaaactaccagtttatgattcatgtggatcagagttatgtacctgtataaaaataacggttcgcagatttccgcgaaccgttattactgacagctttatttattgcatgccctaatcctctgcaaaaaatgcctgcatagttacattttcctttgctacctccacaagatttacacaactgtttccaatccggtcaatattatggagcacatcattaaacggaatggtaagtttggaatcgcactttccctttcccactctggcaatatggtttttgcgcattttttcacccagctgcatgatgtcttctttttgccgcatcagttctttgatatccatattcccatccccggaaatcgcctgaatgcagcttccgaaaatcatctggatctgttccattgcctttttcagttctttcaaagcatctttggaatacttatgttttcctttattctgttttgccacggtttccatgatttccctcgtcagctgcccgatccggtcaatatcacagagaatgtactgcataccggcactttgtgatgcctgttcctcggtcagcacacctccggaatacagtgatgcaaaataatcattgaccgaagcatacagcttctgcagtattttcgccttttcttctacaagttctgcattttctttatcaatctttccgtttctgtactgcagttttccgatcatttcatctacaagttttgcgcagtacattacttcttttgcaaccagctgcaatgctgctgccggctgtgcaatcagcttgttatccagatatttcggattttcagctacttcaacttccgtttcctttccctttccatccggtacaagtttcatcacaatctttaccatcagaggaatgagcggaatccagatcagcgtcatgacaaggttaaatccggtatgtgcatttgcaatctgccgtgaaatcacatcaatttcgtttcccttcggcgaaatgaactgaatcagggctgcatacggttttacaagaaacaggaataaaattgctcccgaaatattaaatacacaatgggcaaacgccgttcttctggcatctttcggctgtccgatagaagccagcactgcggtaatcgttgtaccgatattgtctcccaacagaatcggaatggcaccggtcagtccgatgatactggtcacgccgtccggtcctgcctgggatgcaaaattctgtaatacagcaatggttgcactgctgctctgtacgacaagtgtcatgacagcacccacgcataccccaagaatcggaatatgggatacttttccgatcatattgacaaagaatgcactggatgccaatggtttcataacatcgcccatcgtctcgattccaaggaataacagaccaaaagcaaaaattgtctgtccgatatttttgaccttttccttttttgatacaaaagaaataagaaatcccgcaaaaatgaacagataaatataatccgaaattttaaatgcaataatctgcgccgtcatggtcgtaccgatattggcaccgagaataatggagatcgcctgtggcagcgacatcagtcctgcgctgacaaagccgatcgtcataaccgttgttgcactgctgctctgtaacaccgctgtcgtcaaagcacctgcaagtacaccaagaatcggattttttgtaagcagggcaaggattttcttcatcttttcccccgctgctttctgcaggcactcgctcatcatattcatgccgtaaataaagattgccagacctccgaccagtccgaaaataattttcatcgtctcgttcacttatggttcctccccatttcttttcataaactttacactccgtatactttttttctgagattgtaataagtttatcatcggagtgtaaaatcaaaccatcccagaatgtaaaccctgtgtaaaatttctgtaatgctgtaaaattgctgtaaatttgcgtaaagtctgtaaaatccctgtaaatcggtattttcacgttccatggcatgaaacccattgtaaaaatatttccacaatgctagaataaaatagttacaaaggaaaatgttttggaaagggaaaacactatgctatcatgtccaaactgcggaggaaatctcaaatttgacattccttcccagcaactctcatgcgagcattgtcacacactgtttgatccttatgattttgacgggaaaacaagtgatgccgaagaatcaaagacattcgacggagattacgaggtcacgatctttacctgtccgcagtgtggcggtgaaatcttaagtaccgacaatgcagctgccggtttctgcagtttctgcggagcctccacgattctttacagcagaatcagtcacgaaaaacggcccaattatattattccgttccagaagacaaaggaacagtgtaaggaagcgtacgcacgccgtatgaaacattccatttttgcgccaaaagaactccgcgatccttcttatatcgatagtttccgcggaatttacatgccttactgggcattttatatctcccagaaaggttctctctcgctcaatgggaaaaagacttcccgccgcggtgattatattattaccgatcactacgcacttaccggggatctggatgcctactacaaaggtctttcctatgatgcctcatcctcttttgatgacaatatcagtgaagaactggctccttataatttaaaaggcatgaaagcctttacccccgcctatttaagcggattttacgcggacacttccgatgtggatgcaaaagtatatcagggcgatgccgaatacactgcatctgcggaaacaaccgggcgtattgcttctgacgggacatttgccggttttaccatggataccatccgtcctgaacagctccatacaaaaacagaaaccatcgacagtaccatgtttccggtatggtttctatcctaccgcaaaaaaaaccgtgtcgcttatgcaacggtcaacggacagaccggactggtcgttgcggatatcccgattgatccgaagcgttatctgctcggttcgctgcttctggcaattccgatctttgctcttttggcatggtcggcatttttacagccctcttccctggtaatgactaccctgcttttgtcactgctttccatcggtgtctattgttacgaatgcgtttctatccaccaaaaagataccggggcaaatgaccggggcaaaatgttcatccaatcgaagaaagcttctgctgcagacaaaccgaaaacccctgaagcccagccggagccagccgcaaaaacgaatccgcttggctggattcttccgctctgtgctgcggtactttcgtttggggtatggttcctgcatccggtatcggatctctactattacggagccgcaattctttccatggctgccatcctcgtatcgttcatcagtattatccatgcgtataatctgttatccacccgccggctgccacaatttgacaaacagggaggtgatgaccgtgcgtaaaataaaacgtatccttacggcatttgtattttgtctgatactctccgccagcaccataccggtttgtgcatccgcagtttccgcttccaatgaggaaaccggctacgtttatgtgctggatgattctgcggattttctgacagactcccaggaaaacagtctgcaaaagcagctgtatgacctgacagcatactgtaatgtggcttttgtaaccacaaccggacacagtaaatcttccaccgaagattttgctgcagattattttgatgatgtctttggtccgcatgacaacggtacgatcttcgtcattgaccgctgcctgaatgagatttatctctacagcgatggacaggcgcacaaaatcatcaccaattcccgcgcacgttcgattaccgataacacttatacctacgcgcgcgataaggattattatacctgtgcatacaaggtctttgcccagatcgaaacgctgatgcagggcaaacgaattgcagaaccgatgcgctacctctgcagtgcgctgctggccattgttgctgcactgtttctcaatctcttttttgcgctgtggagttcacgttcccacaaggcagaccgcagacaggtgatgaccggattgtatgcacagatgcagatccataacccacgcacacaattcatccgccagacgcgcacctacagtccggtatcttccggcagcagcggcggtggacattccggcggcggtggcggtggtggcggccactccggtggtggtggcggtcacagtatataatcctgtagaaaatgcgcatttgtggtaaaacagtgctttaaaaaatgcgcatttgtggtaaaataacaatataaaaaatgcgcatttgtaggagatgtttatgtttaagcgaaaaatatatgacaagctcttagcctggaagcaggaatctgcaggaaaaacagcactattgatagaaggagcccgtcgaattgggaaatctactgttgtggaagaatttgcgaaaaatgaatatgacagttatattctgattgacttttccacggcatccaaaaatgtccgtgaactttttgaagatgtttccgatttaaattatctgtttttacaattacaatttcaatacagaaccgatctgatagaacgaaaatcactgattatttttgatgaagtacaactttgcccactggcaaggcaggcaattaaatcgctggtcaaagatcatcgctatgattacattgaaacaggttccctgatttccatcaaaaaaaatgtgcaaaatatacttattccaagcgaagagcgaaaaataagtatgtttccgatggattatgaagagtttttatgggcgctaggcgataccacaactccggttcttttgcaaaaattatttaccgctcaaaaaccggcaggcgagagcatgaatcgaaaactccttcgggatttccgtctatatatgctggttggcggaatgccacaggctatagatgaatatatccagacgaacaattttcgcaaagtggatgctataaaacgtgatattttaagtttatatgaggatgattttaagaaaatagatgcaaccggaaaactctctcttttatttgactccattccagcacagctgaacaaaaatgcttcccgctatcaggtatccagcgttctctccaatgaaagagctgacacaattttagaactgattgcagaactgaaagattccaaaactgttctcgtatcctatcatgcaaatgatccaaatgccggcatggcaaccaacaaagatttatcaaaattcaagttgtttctctgtgataccggattatttacgactttaatgttcaaagataaggattttacagaaaatattatttatgaaaaacttttaaacgacaaacttggaacgaatcttggatatctgtatgaaaatgtcgtggcacaacttctgcactccaatggaaacgagctgttttaccatacatttatgaacaaaacctcacatcataactatgaggtcgattttcttcttgcacaaaaaaataaagtttgcccgatagaagtaaaatcatccggttataaaacacataaatctctggatgcattttcactgaaatattccgaccgtattctacagaaatatctggtatacaccaaagatttctgcaaagacggtgatattatatgtcttccaatttatatggttccttttatacattaacaaaacaagggcagcttctctatactgcccttgttgatattatttatttttaacaatttgatatgtatgatagcatacttaataagataaacataatcgttcctcttataaaatcatccattttttcttttatcctacccattcctttatttgttttccccctaaaagttatgtatgcgtaatatccatcgctctttactatcggtataaaattaattaataagtttgatataaccaaatagcaatacggcaataacttaggatataaatacatcacccctaaaacaaataaacaattagtaaagtttcccgctaaatacacggctatacgtttatatttaggcaacaaatagctatatgatgtatctacataaaaggctggatatataaacacaaatttaaatcctacttttatcttgcttttattataaaaaaatttcaaacagaatatatgtccaagttcatgaataaatatattcactattaaaatcagtgttgcctgaataaaattcaaatttattaatgcataattacaattttttaaataaagccatatcgttaatactataatagaaatcattaaaaccatataaaagaaattatcttgtatacttttaatcaaaatcatttccgctttattaaatatttcattaaattgtgcattactcaatttataaaacttattatcatatgctacaaaataaattttgtttttttcatcctcagaaattatgtaatcattatatctatatattttcaaaataatttttttctttcaataattttagaaaccaatcatcgcaaaacaaaaactcacataattcgcaggtcgatgttaatttcaatggatattcaatattattattatgtaaaaattttaaaaaaggagtaaatccttgtgtaaaaattgtatataaaactttattatatttaatattatccataacatcaatcaatctattttccgctaaattacccattagcaatatagtattctctataacctgtgaacaacaaggataaatttccaatcttggattaattaaaatagtttttcctataacacctgcacatttgggttcatgtttcgtaagatcaaatatttttaaaaactgtgaattcttaaaagatgtttttgcagctccggttcttatagtcggttgatatgcaaaatttgttttatatgcgtagtttcccagctgattgataatatctcctggtgatacactattttgcagaaaacatcctacaatttctgtatttacctcaagatcgtccgcaatttcaataatatttaatatattttttaattgaataaattcactatgaaattcatcataactaaaagaaagattttttaatttagttttatatctactaataaatttttttgccttatctttatcacttccccaaaatccgtttgttttaattgtaaaaccaacatttcttccataatcataattaaaaatgtattcgatcaattccggatataacatgggttctccacctgtaattcccactacgtcaatcgtttcacattctttaatattatctaaaattaattttagttcttctttagataatgttttaccaattactctgcctctggaatcacaacacattttgcattttgcattacaattttctgtcaataatattccgcatgaattatattccatttttctcccatctccttctaaaaatataaacaatacaaagaacaactccaaaaactccgattgaatatcctatattttctccaattgttaaatattttgtattccctgtattaaaatattttcccaatttcaaataaacgctatttgcagcatcataacgtgcaaataaacttaaatgagcatctgccgtagcaactataatagaaaacagccaatacccaaaattcaccatatagccaaccatcatgttcttaaacaaaaatccccataatccttccagtaaaacctgaaaacatattacactttcaaaatacacgaccattatcggcaaataggaaaaatccatatagataatacctacaatcaataatcctataatggtcggaatactgatacaaaaaaaattaattattaacttctcaataaaatattgaaaccaattatatcccataactttatagaataaaatgtttttatttttgtaatctctggaaaatgtctgtataataagcactggaaatataagcattccaaactcggtataaaccgtataaatactattatataattcagcaattgtcggatttgtaattttatcaagactcgccaataaaatatagcctagccaaaagcagattgcagtcgtaataaagcaaaaaatataatatttattttttatagtttttctaatctccatatttcattttccctttatatatctatctattacttcctgttttgaagaaattttcaacatatttctttctgaaacataataatattctccaggcatatattctaaatcagataaattatgtgtgatattaataatgacaccatcgaaaatttttaggtactcattaataaaattataaagatctaaagtactgtttttatccagtgcagtcgtaaattcgtctaatataattacgtctacctctgcactcaaaaaaacatataattttactttctgtttctgtccgtcactcatttttttaattgctaaattatctggaattaaattcaattttaacaattgatatatattagtcactttatcatgtttaaagcgtttttttaataattgcgtgatatctctaattgaaaattctcctggaatattgctactgctcccaatcagaattgcattatgatttccaattattgtgccctcatgcctcagcatacctacacaagattttccaaaacttgactttccgcatccgttatttcctaatatatgacttatcattctatttgcaaataaaacatttacattttcaaataatatattattttttattttcaatccgtaattttcaagtttcactatgtactccttattcatacgaaaacttatttgatagccatatcggcttagtcaaataagttttcgtctactattttattaacttttaaatatttagcctttacttcccacaataactttagcatttgcgcttataaaataccataaacttctaatgttttccaatttcagatcctccaacttatttttcatcacttctttgtttgtttctttgttttctttaaaatcattaatcttcataattcttacctcacataatttgattttttaatgctttgaatataataatcgttctaaaatgaaaaccagtaacacccttaaactatccttatttttgtaaaatttcaattttttttacaccaaacgacatttaaagctcttttttggtcattgtgtgtcatagatttaataataattggaagttgcactcctgctgtcatttgtattccaacacacatactgataatcagattatgatatccctgtataaataaaatgatacataacatgtctaatgtgcacaccaaaccaattacgatttttttatatctgtatttctctgcttcatccagcctcctgctttcatgatccataggactgaatttgattaaactgactgatgcaataacagtgacaaacaataacttccaatcacattttatttgcatggaaaatttgatacacaaaaacagaagtaaaatggagccgattgcacaatgagaaaatgtctttgcatgatatccgccactatattttcgaagaatcataaaagggactacaagtgcaattccactttttatgctcccaagaataaaaccaattcccacagcgaacaataatggcaatatcaacaaccccacactgtataatgcatatccatacagttctttttctttctcattaattaccttttgcctgatcatccaatcaaccactgtctctgtgtatcttttcataattacattctcctgtactttcttaatccttcgggtgctttaggctgatacaaaagacaacaggatgtactgtttgcttctgtgcgcaataccatatccagtgccgtcttcacaccttttgccatagattcctttatttgctttttcatgtttttcctcctttcgttgtataaatttgttattggttttcacgtcattatcatatcgtatatccacaaaacattccacttactttgtatgagtaaacattttttcttatatattggtaaaaaaatttttttaatcagttaaaaatataggtatgacagaatacttctgtacagactgtagacaaagtcctcggctttttgccgaggatttttctgtattaaagaggctaaaagtcagtattttcaagacttttcagtctaaagccgccgtttcaaatgggcgtgtcaaattgtctgctctacgacggctttttttcttttgccgtcgtgcggcagattaaaatattgaattacaattcattgatggttgcagtaatcggcatgttacagatgcgttttgccggagcgaaaggtgcaagaagagaagtgaacacaagcaacaccagtatttctccaatagatgttaaagggatttgccatgccgttccccaataatttgtaatcatctgcgaatagagaaaatgatgcagcggtaatcccagaccacaacctgcgaggagtccaagcgtagtgtacgtggcggtttccatgagaatcatcttcttgatttgtaaactatccatccccactgcacgcatggctccgtattgatttgttcttgcagacacgctcatagaaatactgtttaccgtatgaataatagtaatcaatgtgatcacggcgagaaatccataaacaaacaggcagaacataaaataggtattttgtgtgtctttgttttgcgccagtcgatcataaaagcgataatgtccatttgccaatacgtgaagctcatttacattctgctctgttgcttttttggacagctgtacgtcaagaacagcataggcatctttgcctgtaatttccttgaacgttttctctgagcaaatcacagttggctgatccgatgtatcaaagggactatctttcaagactccagccacggtaagctctgtctgctccagctgaatcgtatctccaacctttaaagaattgcttttatcaaaaaccgtcagtacaccgttgccttcagagacagccgatatatcacctgcaatcaaatcttcagctgcccactgaaactgctgattctcataagaaatcaaatcaatttgccccaattttccttcatattctgcaggaaggctttgatacatccgcccaaatacccgctttacatacggccggctttccacctctttggcaaaactttgtttaatgtcgcacagattatcaggactactataaaagacatctggtgcccatggctttaagggattgagtgccatattcacccattgtataagaacagaaaagctcaaaatcataatgatgctgagtgcaaaggagccagtcatgagaagtagatttttgggagaggatacggcatgatgaatccccaaggccatctcaattttcaaaaagttctgcttgattggccgggatgtgttccaattttcggaaagatttccggtaacagccgcaaccggagaaacacctgccgcccgccttgcgggagagatggaagataacagcacggtcaaaacaccaacaacaattccgctgatgataccgacactactaatcccaaatagcggaatctgtacaaattcagcgcccgcaccaaaccggagcagtgcacaaagcatccatgtgcccacaatcccaactatcacgccaatcggaaccgctgttttgcaccaatagagtgcttccaacttgactatgtgcataacttgtgcccggcttgctccaatacaacgaagcattccaaaaaattgtgttctctctgcggttctgctgttcaagcttcccgcaatcataaagactcccgcagccaaaaccagaacaaacaagattgcagctacaaggtacattcccatgacataagaatcactgctgaagcccgtcaatcccagcaaagccgtgttttcggataatgtttcgtcggtaaagccatatgttttccgcaactctgcaatcaccttacgaatatggatattctcgtaaaagcgcacaaaacaaacgggagcaagcttacttccttctgcttttgcaagactttggaaggagtcccaatttagaaaagcccccacaatgtcggcatctgtggtaatggtaacatctcctccaaaaccggaaatcgtatagccaaaatctccagctggtgtatgtacggtaatcgtctctccaatcttcagagaaagcagttcttttgaacgattcgaaagtaaaatttcatcctcttttgtaggatatcggccttcagtcaaattgtcatagatctccgttagaatcgcattatcaccacctacgatgacgcagctttttccattgatcgtatagtcttcggataaatcaaagttcagtccgtcataacgggaggacgtcatcacatctgttcgctgtgcgatttgctcaatctgttgctcggatggctccttcaacatgatatgccagttcccatgttctttgatcactcgtgtcttttccattcggatcgccatatctgccatgctgaaaatcatcgtaaccaacagcactgagataatgatgcacagcatcgtcatcctattctgtctcttccgcacctttgcagaaatcggaataaggctaagatagcttttcattcgcggcacctcccgaagtcggtcagtacaccgtccgatacctgcaaaacccggtcagccgtttgcgcgatactgcgattgtgggtaatcataatgatggtttgttcgtattttttcgacgcctcttttagcaaggcaatgacctcgctgctattctgcgtgtccagattgccggtcggctcgtcagctaagatcagggctggccgggtaatcagtgcccgcccaattgccacacgttgctgctgaccaccggaaagctggctcggcaggtgatttcggcgctctttcagattcagcaccgccagtagttcttccagatactttttgtccggcttctggtagtccagcaacacagggaatatgatattctgctccacggtcagctccggcacaaggttgaacgcctgaaagacaaagccgatattcctacgccgaaacacggtcaacttcttgtcgttcatggaaaaaatgtccttgccgtcgatcagcaccttgcctgacgtaggcgtgtccaatgcgccaatcatgttcagcagtgtacttttgccggaaccggattctccgacgattgccacatactcgcctttgggaacagaaaagctaacatctttcaaagccttgaccgcggtttccccattgccataggttttacaaatatttttgacttctaacaagttcatagtgcaaacacctctttctcaataattttgctgtcgtaaacgggtggactttcgttccctgtctacgatggaaagaatagcaccccaatattactgtaaccctacaaccagcctacaattttgtaggaattgggaaattcattataaaactcgttccaattcctaattcactttccacttctattagacccccatgagcttcgataattgcttttgccaacggcaggccaagcccgatcccctgtgtatcctttgaaaagcggctgcgataaaacctcttgaagatgtggtgtaaatcttctggatgaatcccgcacccgttatcctttactgtgatttgaacagcagagggcagtgccttccatttgatgtgaatggtatcgcccttttctgtatggtccagcgcatttttcacaatgttgccaatcgcttcactcaaccaatcacggtcacagaaaagggaaatatcatctgcaccagataagacgatctctttctgttcctgcttggcacgatacgcaaagtgtaactccaaatcctgcatcatatccgctacattttgtatttccttttcaaatgcaatagaaccagcgtccaactttgtgattttgagaaggttttgcaccagcacttcaatacggtccaactcctgctcggacagattagcaaattctttcacagatgacacttctatatcctcgtcctgaagcagtccgttataaatgttcagagccgccagtggtgttttcagttggtgtgaaatgtcggagattgtatttttcaaaaactctttctctcgcaactcgttatctgcatgggcatttaacactgccgctaaagaattgatggaatgaaacagtcggtacaattcgccctcattgtcacattcaatacgggcattgcgatcaccatcaagatacgcattgatttgtaatatcgcctgctccatgatctgattttgccgattaaaatatacaaagcagactgcccatacagcaccgccagccaatagaaaaaggattagcaataacagagaaagccggcgatatgacagccatagaaaaacctcggtcaagagaaatgtaacccccaaaaccagtgaaagcgaaagaaatagatttttgatttctttatttgccagtatcttcattctgcacctcacccgataatattccatttatatcccatacctcgaacagtcaggagcatttgtggttcacttggattatcctcgatcttcatacgaagccgacgcatatagaccgtaagggtactactgtcgatataattcccgtcgcaatcccatagcttatctaaaatttgtccttttgtcagcaccatgcttgggtttctcataaacaagcacagtagcttgtattccgcggcagtcaaatccaacagctccccatttttgaaaacctgtccttgcagcaaaagaactttgatgccattcgactgcaattctgtgtctgctgcttgaaaagaatttgcacgtcgaagtaaggcgttaatccttgaaacgagaacccccagtttgaacggttttgtgatatagtcatcacctccaatatccagccccataataatacttgtttcctcatccgaagccgtcagaaaaataattggcacctttgatgtaagtcgaactcttttgcaaaattcaaagccagacccatctggcagagatacgtccaacaccaacaaatcatattttccgtctgtccacaattcctccgcttctttgagcgttctggcgatatttaattcaaatccctgctttttgaaagcaaaagaaagcccattaatcaggcttagatcatcttcaagaagtaatatattactcatacttttctgccttcccttgttttgtccttccgtcaatcggcttttctgcgttctttgggatcagccaaacaccagccatctttacagcgccggggatacgcccagcagcgcaatagtaatttactctacgaggtgtcacgccccatttttcggcggcctcttttagtgtcatataatccattctgcacctccacagagtacattatagttctttgtctcgaacaatacaagtttatcaccaatcgcagctttatataatcggcataatcgtacagcttgtccgagaaatttgaaacaaattgagccagtgagagaatcgttaaaattcactcactggctcttttcattttaagagagctagttcgtctaacactatatgtatcatcaaatgaaaatttatctgttttataatttcttcacgaaacattatttccaactgaataagaaatattttttacttatttccatattacgctttgccttcgttcaaataacccaggcttgttcaaaaaacctgatggatatgcactgacaaaatcattatctttttttcctaaccacatgaacaattatagcaatcacaacgattgcggcaaccatgccaattagggggagccatgtgtctacgatactttgaaacacagcctcccattttacattttcaggtaacatgatttacacctccaatttcttttgctctgtaacaatgcgtttacaagatagataggttgcaaggaaataactcccgtaaacaatgaggaaaagaataatggtcaatccgatatttgttgaaatatggatattcataaattcctcaacgacagtcattgctttgccgattaagaaagccgagtatattccggcaacagttaacggaattgcaaaaaacacagccgcctgcgtaaaaagtgtgcggttaatttgcttgcgcttggctcccaacttttgcagcaatccatatcggtaaatattgtccgtcgtttctgtgagttgttttagtgccaaaagagcagcacagatcagcaaaaaaattaagccgatataacaacaaaggaaactcaccaaagcattgaggccgtagaacatttcatacatcatgtctttttctgcataccgatagccgtgcgtttcgtccaacccaatggggatcatcttttgcaggatttcattagaatccacatccggcttgtattgcaccaatagcacattaacgtctttttcgaggacagccactacatgatccgggacaatcagtgttccgcgatcattgtttccaacagaagtcataaaatatgtttcttgcagaacttcatcggatgcacgcagtaaggttgttccgcctattgtaatttccgaatgtttttgtaaggccgcagaaacatattgatatgtcccagtgtaattgcagtttaacaagtattggtcgtcgttcagtgtgattggctctttgccctgcatagtcaaagcacgattgaagtccgaaacgggaattacggcaactttgctattggaaacttcctcatcaataggccacagctcgacattctgaccttcaaatagctctgaataggtcatatcggcctcataaatgctgatttgctccatgttttcggcgtaatcacgcattgcaacatcatgtgtggcaagatactcggaaatgttgctgtctccatcagcggaaacattggaaagtacattcaaatcatagggggttgcagcttttgataattcattcattgcaagagctgtgcttgccccaatagatacagcacagatggtaatggtcagcaggccacaaacaatcgtcaccacaagataattcgtgcgaattttacttccgatttggcgtacaaggaatgtgttcaaacctttcagataaaaccctttaccagctcttaccacttggatgaaaacagtggataatgagttgaacaacagaaaggttccaacaaccaaagctgctcccgcaatttgaaaagacatattttcacgagatggcagtattccgtttttgttgaacagcacagcggaaatccctatgcagatcagggaaagcacaaacagacaaagcggcaaaacacgattttctgcttttatgctttcgttttttctgctggccgtcaataagtcaatcaatttgacattggttacagaccacacattgaaaagcattacgataaagaagatgatcgcaaaacaaagcactgtctgtcgaaatgctccagcagaaaatacgatttgaaatttatccaattcaatcgcaaagagttttaatgcaaccaaagaaagtccttgcgaaaagagcaacccaagaaccaaacctgaaaccaaagcaatgacaccaacaccaagagtttcaccggcaaacagccgggaaatgcgtctttttttcatgccgagcaccatatatacgcccagttcttttttgcggcgtttcaaaagaaactgattggcatagataatcagaaaagccaatactaccgcaatgataacagaaagcgccgacaacagtatgccgagttggtcgtataaaagcgaaccggttattcccatatcggaaaaagctggctgatcggaaattgagttgaaggcataaaacagactgaccgaaagcgtcagtgtaaggaaataaatcagatagtcccggatgttcttatgaacatttcggaagatcagcttaaaagaggtcattttgctcacctcccaagacggaaaccacttccagaatctttgcaaaaaagtctttgcgtgtgtccgtccctcggtgcagctcattgaacacctgcccgtctttgataaacaaaatgcgatggcaatagctggcggaaaaagcatcatgcgttaccattaggattgttgccgcaagctgttcgttcaattccgtcagcatcgtcaacagcatccgcgaggaattggaatcaagagcgccggtaggttcatcagccagtacgattgctggatttgttaccattgctcttgcagcggctacccgctgctgttggccgccggacatctgatagggatatttgttcaatacttcctgaatgttcagcgcctttgcaatctgcgggacacgtttttgaatctcactgggtttggttcctgcgatagacaaggacagcgagatattttcgtaggctgtcagagtatccagcagattgaagtcctgaaagataaagcccagcttttttccgcgaaagtctgcaagctgtgatccgtaaagcgtcgtaatgtcctttccctccacataaatatggccgctggtaacggtatcaatcgtagaaatgcagttcagcaaagtggttttcccggagccggaagaacccataataccgagaaactcacctttacgcacagagaaagaaatatgatcgacggcttttgtcaggttgcccttgttaccgtaaaatttttggatgtcatccacccgtaaaattgtgtcgtccattgattatgagactcctttctcaaaagcattttgcttttgtatttttactctaccataggggcttctcctgtgccattaagttagattacatttaccttaccagaatgtaaggttgaaaaaagcgaggttttacagccccgcctctttcaaatagctctccgtaggaaataccatagttacggtagtcccttgtccgggatcactggaaacggaaagcacaatattcatttttttacacagcttttggctcaaatacagcccaatcccggttgacttggaatagcggcgtccgttttctccagtgaagcctttgtcaaacacgcgtggtaaatccgcagcagaaattccaattccattatctgaaataaaaagggatatattatttttatctgttttggtagaaaactcaatttgcaaattgtctttacgatatttgatcgcgttggatatgatttgtccgattacaaatgtgcaactcttgctatcggcaacaataggaatgtccagatcattcagcactggttttccgcctgcttggatcagaggtttggaatatgtctttaacgcagcatgaactaaagattgcagtgtggttttttccaccttgaaatccttttccacatccgtactgcgggcatagtatagcacctgttccacataggtatcaattttgcggagttcatcgtcgatgcgtagcgtagtgggatttttttcgttttctatcatcaggcgtgcagaggtaataggggtcttgatctcgtgtatccatgaatcaatgtactcccggtattcccgacttgcttgttttgcattggaaatctgatcgttctggtatttattgcagcgccgcaaaatatccactaaaatctgaccttccaaaaaatgaggctgtgtcaatagttcacccagaagcgacttttcttccatctgttccatcattttcagaagtagattataataacttcgtttgcggaaaaaatcatataccaaagcggaaatatacgctgccataaggatcgtttcggcaaacagaataaaagtagcaggggtttcaattagccaaagcaggccaaacagtaggagtgccgacaccagcatacatatcaatgaaaaaattcgatctaaaagatactcggataatctcatacgcaataccccaatccacgcttcgtttccaaatagtcaggcaaaccgatctctgccagcgttttccgcaaacgaacgatattcacattcaaggtgttttcgtctataaattgctcactctgccagagttcatcaataatggcatcacgaggaatgatatttcccttgtttaccatgagcagacgcaaaatccccatttcatttttagtaagagattttctctgtccttggtaactgatttctgctttgagcaggtttagagttaagcctttgtgtgtcaaaaccacattgtcctgtatttcataagttcgtgccagaagtttttgtatgcgtgccaaaagaacctgtgcattgtagggctttgaaatataatcatcggcaccgatgttcaaactcattagttcgtcaaaatcgctgtttctgctggtaagcacaatgattggaagattggatttctgccggatttctctgcacacctgaaagccgtcctgatacggcaaattgatgtccaaaagaatcaagtcagccccagacgaaagggcggtttctgcgatatgctgaaaatcgctactactggcacattggtatccgtatttttcaaaaagttgggtaagttcctcacggattgctggttcatcttctatgataaaaattttcattttgttgcctcccttgcgttgttctcatatccaacggcttctccgcaattttagggagcagccaaaccccggccattttcacagcgccggggatacgcccagcagcgcaatagtaatttactctacgaggtgtcacgccccatttttcggcggcctcttttagtgtcatataatccattatgcacctccacagagtacattatagttctttgtctcgaacaatacaagtttatcaccaatcgcagctttatattgaataattttcatatcttccttgcactcgaccggcggcaacgatatactgcctttttgttaaaaggaaccccacatcaaccattctgctgtcacacgcaaatcctgtgatgagcctgccattatctgttttctgtggatttactacataatcgatgatgtcactgatcgcccgactttctgtgcggtctttgccaacatgaaacggcatgattcttgtggttgccataatgcttcctcctctccaaacacaaaagctgccacccaacgaatctttatcgtcgaagtgacagctttctgtcattatacacacctttgtaatggtgcttttatgttcttttactattcaaaaattcaaccagctcatagactgtcgttaccggattactgtctcggcagatcacagcaacctgatctctggttaatctctccactcgttcttttgcgtactgaatagcttctggctgatgttcctgcaattcttcaaaaacatccacactttttccgtaattttccaaatatcctttgtttttcaagatgtcaattaccgtagcggaatctttcaaatatccattccgtttttcaaaatggagcagataccaatattcaaatgccggattggaatatgcgattttgtacccatgcttctccgaataggaaattgcagcttgaagctcagagtctttattatcatcacagtcaaatacacaccaaagctgatctccgtctttcggataataatctgcttgagagatcagagattttgcgtgtttcaccaaatgttccgccgctttatgttttgatggaattgggataatatccaccagacagtttcgtgaacgaaaatgtttgaaataaagtgtctctgtttcttttccttcgcagatgatataaacaatcggtttacgcttccgccgcttaactttgttcggatcatactcttttcgcatcttgctcatcaggcgtcacctccgataaaagggattgcaccaaatcgtccctgaagataacccttacgcacattttctccttttcttggagagaaagatgccaacgagtaaagctctgttgcacaagtctcatcgtttttttcagcaaaccaaatctgatctctacggaagaaattcaagtcaagcagcattgcatcgtgtgttgtaaaaatcagctgcgctccctttgtattgacagccttatcctgcaccatttcaatcaaccttctggttaaaagaggatgcagactatcttcaatttcatcaacaactaaaagtgcgccgttttcaagtgcctgcaaccatcctccgatgcgggcaaaaaagtgttgtgtaccgacagattcctgctccattaaaagctgaaagtattctgttgtaccgtcctcgttaataattcgatgtgttgtcgtaataaccggtattttaccagaggtattcttgattgtaacatcggtgattccaagatcggcaagcatcaattcttttaagattcgagctttcttatcatcaccgctgacaatctgggcaacagtttctgaggtagctggctcttcatccatcaggaatgtcaacttttccaggaaccactgataagcattttccgtctgaggcagattccagtcattagaggacaccagatagagcttattgtccggtgttcggttactcagagtaacctgctcatttacattttcccggaactcatacactccattttctcttgaaaaaattaaggcttcacggccattcggccaatggtaaagatactctttgtaaatcttctttgcatcaaaagaaaaaccgtatgtgtaacgaactccctgaaaaataaataccatttcaaaagaagtcggaacctttgttcctccaaacggctcccacggcaacttttgtcccttagaaacttttgcagcatttcccacaaccatttctttcatcgtcatcattgcatgtaatacgttactttttccggctgcatttgcaccgtaaattgcaagtactggcagcaatctcttcttttcatctggatgaagcagatactcttcaaatgacttatccttagaggccgcaaaactgatcacggcactgttttttattgacctgtgattttccactgtaaactgaatcagcataattgaatacctccattctcagtattcgtattttcagtcactattataacagttaaaaatgccttggtcaatatttacggattgtttttgcagtttttctgcgaaatttataaataaattctttctcagccatttttcgcaaaatatttatcaccattggtgaattggaatccgagcttccagtttgcaagtttaagttctgatttagctaatcgcttgcataagtaaattctggcaaatcaaaatatcatgatttttatggaagttagttttgcaaagttcttcaaaactggaatttactattagaaacaagttgttttatgcttcatatgctgatattctttttttgagatcttaatcctctgaaaaaagagtcacgttaagcggaggtcgaattttatttcttttttcgcaagattaaattccacccctcattcggttcagtatttcttccgaatggcgctacgtttcttattttttcagtaatagaggtgtaaggttaatctcgttagcgggaatggattttattcctaaccatacaaccagtcaaatatttctgtaacgaacttggcggtattgttatcacggataaaagcaagcattgtcctatatttaaccactaaaaattgggtgaaaacggctctcgtttggtcaaatgatgtcaaactatatcagcccgtttaggtataagaaaaccccggaaaaccttgattttccggggtttttgaaccattttgatatagtctgagcagtcgattatctcttgctgaactgcggagcgcgacgagctgccttaagaccgtatttcttacgctctttcatacgtggatctcttgttaagaatccagcagccttaagagtaggtctgtactcgttatctacctgaaggagtgcacgggagataccatgacggatggcaccggcctgtcctgagtatccgccgccctttacgtttactaaaacgtcaaacttgtcaactgtctcagttgctactaatggctgacgaacgattacctttaaagtctcaagacctaagtactcgtcaatatctcttttattgattgtgatctttcctgttccaggtactaaataaactctggcaacagatgattttcttcttcctgttccgtaatactttgtattagccaatgttgtttacctcctctgattagaatgttaaagcttctggcttctgagctgcatgcttgtgatctggtcctgcgtatacaaataactttgtgtacatctgacgtcctaaaggtccctttggaagcattcccttaacagcgaactcgatgacacgctccggatgcttgttgagcatttccttaagagttgtctccttgattcctccaacgtatcctgaatgacggtagtataccttctgatctaacttcttaccagttactttgatcttctcagcgttcacaacgattacataatcaccggtatcaatgtgtggtgtgaagattggtttattctttcctcttaatactttagcaacttctgatgctaaacgtcctaatgtcttgccttcagcgtctactacataccactttctgtcgatggtagcaggactagccataaatgttttcatgggttctcctccttgatagatattcaaatcaataaaatgcgaacagtttcaagcctcgtatgtccggacgctgctctttcctgctctgcttttctatatagtttaaatgctcgccggggcttttggctcacatttacatactatcacagacttatatattatattacccgggtcttttgttgtcaagcagatttctcgtgtaaatccccatttttccacctttatccacaggttctgtaaaaaatgccatctatatccacaatcaaaatctattttttgacatattcaacaaatcaacacaaaaatgatcctattccgtggtttattcgtactccagtccgatcattgtcagtccgtgtgcaggagccgtcggtcctgccacactccggtcacaggcatctaaaatcgtctgcatctcctgtggggcaaactctcccgctcccacctttatcagtgttcctgcaatgatccgcaccatattatacaagaacccatttcccgtcacccggatcgtgataatatccgcttctttcgtgaccgtacatgcatagatcgtccgtacgctggttttcgactgtgcattgaccgcacagaaacttttaaaatcatgctcgccaaccagataatccgcggcctcctgcattttctccacatccagcggataatgataaaaatatgtatccagccgcctggtcggcatgcggaaccgccggtttagtatccggtactcataggtctttcggcttctggaaaaacgtggatgaaaggtatccggcacttcgcaggaatcctgcaccacgatatcttccggcagcctctggtttaatgcgtagctgatcttctccgccggcatacgggtatccgtatcaaaaatacagacgtttcccagagaatgtacccccgcgtccgtgcggcttgcgccggtcacgcggatgtcttccccaagaagcgcctgcaatgcttcatttaatttctgttcaatggtcacaccgttgggctgaatctgccagccgctatagttggttccgtcatatgcgacgaccatttttactctcatatttcttaatcctgttctgtcaaatttcctgttttcagatgatttatatgctgctgccggcagtcaccgtcctgctactgtggccagcgcaacagcactcgtgcaacaatcacaagcacaagaaatgcaatcaatatcacataggctttgcggtctgttccctgatagcgcagcggtttcatctttgttcgtccctctccgccactgtagcagcgggcttccatggccatggcaagatcgtccgcgcgacggaacgccgatacaaataacggaatcagaagcggcaccatgctttttgctttctggatcagattgccgtcctcaaaatcggcaccacgcgccatctgtgccttcatgatcttgtccgtttcctcgatgagaatcggaataaaccgcagggcaatggacatcatcatcgcaatcgcatgcaccggtatgtgaatccggttcagcggagacaatgctttttcaagtccatcggtcagctggtttggcgtcgtggtcagtgtcatgagagacgttccaatgatcagatagatcagccggatcgtcataagcaccgcattcataatacctgtactggtcagatgaaacggtccccagtgccagtactccgtaccggtcggtgtaaagaccagattaaacactgccgtaatcaaaagcagcaccacaatggcttttaacccttttacgatatacgaaaacggtacttttgaaattttgatcataaaaataagcataccggttatgatcgcaaatcccaaaatgccctggaacgtaaacagcgcaataatatatatcattgtcgcaaataattttacacgcgggtccagtttgtgtacgacagaatctgccggataatactggcccagagtaatatctcttaacataaatttctcctgtgctctgcaaacactaaatgacgtttttctcccgaagtgccgacagaattgtctgtgctgcttcttttgccgtggttgcctgtgtatccacaggaagtccccgttccgcaagttcatgtaccagatacgtcacctgcggcgcagcaagtcctaccgcctcaagctccttataatgcgcaaacacctgcttcggcaaagcatcaaacatcacggcaccatgattcatcacaatgatgcgatccacatattccgccacatcttccatactgtgcgataccagaagaatcgtgattccaagttccctgtgcatcttagaaaccagtccaaggatttcatcgcgccctgctggatcaagtcctgctgtcggctcgtccagaatcagcacatccggtttcattgcaagtactccggcgattgccacacggcgcttctgtccgccggacagatcaaacggcggctgataaaataactcttccggaaacccgacgttgcgcagcgcttcaaacgcccgcagttctacatccctgcgatccagtccctgattcttcggcccaaaacagacatcctcaaaacaggtggtctcaaacagctgatgatccggatactggaaaaccagccccactttgctccgcagggctttcatatcatacccttcatcatagatgtcctgcccatccacatagatgcttcccgatgatgcccgcagcagtccgttcagcagctgagtcagagtcgattttcccgatcccgtatgaccgataattccgataaattcgccctgatgaatctgcagatcgacatcctttaatgcctgaatctcataagcagtaccgtcgctgtatgtgtaattgatcttgtctaaaatgatttctgccatcttttatctcctgcctatgcatttgccacggacataatcgcatccaccagttctttcctcgtaaggattccctgtggaatcggtacgcccgcgctgcgcagttcatctgccacaagcgttgcctgcggtacatccagacgatgttctttcagctcgtccacacgcgaaaaaatatcgcgcggtgtaccgtccatcacgatctttcctttctccatgacgtacacataatctgcgtcaaccacttcttccatataatgtgtaataagaatgatggtaacgccctttttcttattcagatcatgtgcggtagcaataacctctttgcgtccgttcggatcaagcatcgctgtcggctcatcaaaaacaatacatttcggttccattgccacaacaccggcaattgcaacacgctgtttctgtccaccggaaagtttatttggagaatgtttgcggtattttaccatatccacagcttctaaactctgattgacacgcgtccagatttcttctgtcggcaccccgatattttcgggaccaaatcccacatcttcttctaccacactggcaatgatctgattgtccggattctgaaataccatcccggcagttttccggatcggaatggtattgtcctcatcgagtacatccattccatccacccagatcacgccttctgtcggtgtcagcaacgcattgatatgtttggcaagtgtcgacttgcccgatccgttgtgtccgagaatggcaatgaactgtcccgcttttacatccagatttacatgatcgagtgccgtcgtaatagactcaacattgccttcctcatctctgcggaaaaattcgtgtacaacattttttgctttgataattcccattttaatcgtcccagctcagtctgtgaagctgtccttccagcttcatatggtcaaaatcgttctggcgcagtgcctcataaagcacaatggcaacagaattcgataagttcaaagaacgggtttccccgatcatcggaatacgcacacaggtatccggattcgcctttaagatttcttccggaattcctgcactctcttttccgaacataatgaaacagtccggttcataatagacatccgaatacacatgacgtccttttgttgtcgcataataaatttttgcacccggatttcttttacagaaatcctcccagttttcatatacggtgacatcaagatctttccagtagtccatgccggcacgctttaaatgtttctccgataaagaaaaaccaagcggctcaatcagatgcagctttgtaccggttgcgacacaggtcctgccgatatttcccgtatttgctggaatttccggctcatgtaatacaatatttaactctgccatttttaattcttaatctcccgaatctccgttacaaactcagccacgcgatccagtgcaatccgcagatcatccagggaatatgcataggatatacgaaggaatccctctccgcaggcaccgaacgccgtacccggaacaaccgcaactttcttcgtctgcagaagttttgttgcaaactcatcactggtcatacccagatccttaatacaagggaacgcataaaatgctccaaatggctcaaaacaggaaagtcccatctctttgaaccgctccagtacataacggcgtctgccgttgtactcttcccgcatcatggcaacatcttcatccccgttgcgcagtgcctctaccgccgcatactggctggtggtcggcgcacacatgatcgcaaactgatggatctttaacatctgtttgatgattacttccggtccacatgcataaccgagtctccatccggtcattgcatgcgatttggaaaatccgttgatcacgattgttcgctccctcattcccggaatggaggcaatggatacatgattgtccagataggtcagttccgcatagatctcgtcactcaggacaaacagatcatgtttctttaccacttctgcaactgcttccagatccttcttttccataaccgcccctgtcgggttatttgggaaaggcataacaagaagctttgtcttcggcgtgattgcagcctcaagttcttctgccgtcaggcggaattcgttctctgccttcagttcgatcggaaccggtgttccatttgccagtacacaacaaggcacataggatacataacttggctgcggaataagtacctcatcttgcggatctaacatggcacgcatggcaatatcaattgcctcactgcctccgactgtcacaagcatctccttgttatagtcataggaaagcccgaatctccggtcaagatatttggaaatctcaatttttaattcctttaaacctgcatttgaagtataaaaagttcttcctttttcaagggaataaattccctcatcacgaatatgccacggtgtatcaaaatccggctctccgacgccgagagagattgcatcatccatctcactgacaatgtcaaaaaatttccggatacccgatggctcaatggttgtaattgtttttgataatggatttctcattatgccatcataatcctttcatcttttgctttcggagccataacagttccgtggtctttatatttctttaaaataaagtttgtctttgtgctgagtacctgatccaaggcagaaagcttatcggatacaaactgggaaatctcacgaagtgtcttcccctccaatgtaaccatcaggtcaaatccgccggagataagatacacggaatttacttccggataattgtaaatgcgctctgcaaccttatcaaatcccatgccacgctgcggtgtcacacgcacttcaatcagtgcagttactttttccaccccggctttgtcccagttaatcagcgtatgatatccgcagataattccctcctgctccatagcttccagctcattcatgactgctgtctcatctacaccgagaattacggccagctcctgtgtatcgatgcggctgtttttttctataaaagttaaaatcttctctctcatattttattgttctcctaattacattttaccatattccataattcgtctgtctgtgttgtttctaagaatctgcgttcctccccattgataagtacacggtcattgctgtcgattgtccttccgataataacagcttccccgccagcctgacggatcgcatgcaccagtgcattgccatctgccgctgccagaagaagactgcctcccgacagaagcttgtaaggatttaaatcaaaaaattcacagatttctatggtttcctgacgaattggtattttcttcagatcaatttccagtccgacgccggaacactgccccaattcccagagagctccgaaaacgcctccctctgagaggtcgtgcattgcagcaacgccagactttgcggcgactgcggcctccgaacggatagaaagataatctatatattttgccgctttgtcaagaaacggctgtgcgtatctggccgataactcttcccggtgttccgttgcaagaatcgctgttccttccagcccgacccatttggtcacaatcacatccatatccggctgcgcccctgctgctgtgacaaataattccctgtcagcttctcccactgcctgaacaatcagttgcggagaggtcactgtccgaagaacttccgtgtgtcctccgagaaccggaatctgctctttctcacttacacgggataccgccgaaatccatgcacgcagatcattttcgcttgcagatgtcgggagcagaagcgtcatcgtaattcccaatggttttgccccactgcatgcaagattattcaatgccgcataaacgccggcttccggaaacgtgtcaaatgcacggcaggcttccgcagtaacgatctgctttcccgcagaagcatccactgcaccgaaatctattcccactcccggtgcccggaccgcagaattatgaagttgtcggagaaccgagcgctttaatatcgactcggataattttcctgctttcatactgttattttctattcgctttcttggacgattgtgtttttttcgtggatgtatttgttgaagatgttgtttctttcttggtatcctgttttttggaatcttccttctttgtatcttcctttttattattttcatcctttttggaggaatcctctttcttgttcgtatcgctcttgtctgcgtcctcctttttatcggtatcgtccttcttttcttcttctttctgctcttcttctttcttttgcgcgtttgtctttaaaccggctgccgcacttcttactttcgcttcatccccggttgtaattgctgcctttaaagcagaaagcgtctcgcttgtcgcatctttggttccaatggtaataagctttggagttgcctgataattactcttgttgaacagatccctgctctgctgttttccgtccaccttcacaatcttccacaactgcgcaatgcatccggactgtccggactgggtaacagaaaccgaaccggcggtaagggaagcatccattgtaaactgcacctttggatctgtctttgaaacggtttcactttcaaacgaaatctcccggttggatggtctcgtttcttttccatatacattaaaataaatgataccgccactacaatatccttcgatatataccggcgcatccagattatttttaaacttcagatctttataatttccggcaattgccgcatccatggacggttccacataatgaaccagcatggaatgattaaaacgcatcgtaatttccagttctgcccggataactgcattatataaagtcgttgcaacctgacagattccaccgccaaacgattccactaccgttccgttctgataggcaccggccagttcatatccgttctcctgtgtaaacgggctgaccgtttttgccagatcaaactcctctcccggataaaggattgtaccatctactttgctcactccggttatgacattttttgcacgtcctgcactcgaacttgcaaagtttgtcgtataagaaccgatcagatccgtaatttctgcgagttctttctcatccccgcgcggttctaccgtctttgttaccagatcaatctcattattggagccgtcccagccctgtgcaagaaaatcattgattgcatacacggaatttacgacatccacctcgacgccttcttttccctttacaaattcaaattttccattgacacgctttaatccattatcaacagccccgacggcaagatcatctgcgctctcatatatcttttcggccgtcgcctgtttgtttacactcagatgcatatcgagaaccagttttttctttttgagatcctgcagggttttataccggttgatcagacttccggcgtgtcccaccgccaaagcttcctgcacggcagtatccgcatccgcggtcactcccatatcttccgcagtcatctgaatggaaccggtttctcctctcagcgtaaaagttgtatccatcagcccatccacgtattcttctaccgcagatatcgcctgattttctgtcattcctccgacgtttacatttccgatggaaattccattttcaatggtagtctcctctgctgccatcactgcctgtgtatgagaaccaagtcccaccacacaaaaaagtactgctgcagccattcctaactttgttatcttcttcatattcttcctttaaaataattttagcgttatcttgtattttaacataaacaatcactttttcaagtgccgctacccataaatcagcgctgaaaccagtgttgtaacaaccattgcagcgataacaaccaacgatatgagtgcaatcagctgtctttttcgttttgaaccattaaaattatacatactattcacctctttcgcaaaatcagttataatgaatacacaacaatatcagaaaggatttccattatgtttgtatttcttgctatttttatcgtttttctgctgtatattaactttttgatgcataaaaataaacgcgcccaggaaaatctcgaaaaacagttctgggaccgggagcgcagtgcgaatttcacacgcaaaaaagatatcagcaatcttaattatcttatcataacagaagataaaataccacaaaaccttacgaccgatgccaaaaaatcactggaaacactatgcggtcagaaaatgctgaatctttcttccatgagtaacaccgacctgaaacttgaatatggtgttgcaaacctggatgaactcagcgcatgtgatgaccgtttttccacatttgaacgaaatgctgccatctatgcccaggaactgagtgatgccggatataccgatcaggcacgccagctgctggaatttgcagtttcctgtcatgtcgacaacagcagcatctacacacagctggcagccatctatcagaccgggggcaatctctccggaatcttgcagctgcaggaagcagctgcgcagcttgcgccgtttccgcaaaaaatcattctggaaaaacttaaaagtttccagccctgatcttatcctgcagccgggaggcttcactgcgtgtaagagtctcccagctgatactgtctttccttccatattgttccaaaagttccctgagccgttctttttgatgctccgttgccggcgtctgtctctttgccttatacaccagaggtttcgggacaaacagttccatggaagcaccttctatggattttaaattttcaaataccttataggtttctactgcatcatccagtgcccggtgtgcatgttcccgttcaatctgaaaatattcgcacaggctttccagttttttcgactgtgcccccggaaggagtgcccgcgcaatccgcagggtatcacaggccgacaattccagtggaattttctgattgacggcccactgcttcagaaaactgtaatcaaaaatcagattatgtcccacaagaatatcatccccgataaattgcagaagttcctgcattgccacattctcttctttccccaaagccgccatttcatctgtaatcccggtcagctgtactaccgtttccggaattgacattcccggacgcacgagcgttccatatgtatctgcaatctctccgttccgtacacgaaccgccccgatttctattactttgtccctttttggagccagtcccgtcatctccagatcaagaaccgtataatccattttatgcacctgccttacgctttcatacatgtttattatacacatataagaaaagaaaaccagccagaatatggccggttttcttccacaataacgctctttataaaattcttccaaataatacatccagtcctgccacccacagcaacagtgcgccaacgatatatactttggtttttgcttcatatccgacacggtatccggtatagatgccgccgatcacaaatgcaacggtacatacaacaatcatgatcagaatcataagcacattcgtttccagaaatccaaatgcaattcccgtaagcagcgtgtaaattccactgatacatgccatgcggacaaatctccggattccaagatgatgttccagatgttcttccacatgttcgtttcggattgcttttaccatcagccggatgccaagaatcataaaaattaccatggatataatctgtcccagcagtttttcgtccggcaccgaccggtaatggcagaacagggaggacaaaaaatgccccagatataacgtaatcagctgtgccagcgcaacgattccacagatcactgtcagattttttttatttatttttgcaaccagtgatccctgacattccattgctgcgaaaatatccagagatacccctgctattatcagcaggttttccatccagttcatcctttttcctccgaccatcaaaattatttgttattttcactgtctgccttgatcgcatcctgtttataaataaattttacgcttccgtttacaccgtctgcaacctttgtaaatgtctggtaatcctcacccgcatcaagcattgcctgcagtttgtcggtcagcggtttgatatctccgttatagctgttcgcaatcttggaaatccccttctcgtcgaattctaccatgccatctgccagcgtatgggacccgtcatccagtttatctacaccggacacaatctttaccgtggcatcgttgagtgccttgattcccttcgtcagtgttggaactgcgtctgccagagactgtgttcccttactgagtgctgcggaaccggtaaccagactgtaaccgttttcctgtactgcttcaatctgctgtgcaattgtagcctttgcactctctgctcctgtaacagcggctgcacttgctgcctgtacggccacattctgacatgctcctgccagctgtgtagccagtgtctttaagctgctctccacaccgtctgtcacctgctcattgtttcttcctgctgcaagctgtgccttgattgtgctctgtgtcttgtgaaagagtgtgtcctttgccccactctttgcatacagcagttccgcaagctgtgcacttgtcataccatccgatacggcatacataaccgttgacgtctgatcgtttgcctgtgcgccctttgcccacgctgctttaatgccggcagccgcctgatctgcagtaagtttgctgtctgccgcctgtcctgcagctttcagcaatacctgtcttaccacttcattatacacggtttctgctgcatttgcactataagcgccatcataaagagaagtaaataatgcgccatccgttgtgctgccatcttttcctgtgctgtaacggagtgcggcatagatctggtttgcgacttcctgcgtttttccgtttgcaaactcttttgccaccgtctcggaagcggtctttgacgcggcctgtttctctgtatcactcatctttgtatttaacgctttatcaagtgtctggattcccttgctgatggattctgcgctggtgtttaatgtctccacacctttgcccagatctccgctctttgaattcagctcattcatgccgcttgcataatccgcaagatttttctgtaacgtgtccagtccatcggataattcttttgatccgtcttttaacttgctgcttgcatccagcatgtcatcaatcatatcatccagagaagaagaatccccgctcttcatggaaatcatgcttccggcatttgccacgatcgtcattgccgtatccagcttgaaatcttttacatcggcagtcacttcgaaatcttccggaagttccagatcatcgatgaaatcagaatctttcacattcagactttctttgattcccggcaatgcatagccgataaccacattgctgtccccgttctgggaaacttttccgttctttacttccacattgctgaaactgtcatccaataccagtgccgttacggctgcaaacggaacctttaccgtctgcttgtttccgtttacggtttcttcataagaagaattatttgtgtaatcataatgtatggtaacttttccggattttccagccagatccttcggtgcaatctcatttccatccagataataagtaactttcagagaaaccggagcttcactgtctgtttttccctgatagtaaatatcggctccatctgcctgccaggtcagcttctctccgctctgtgagaactcctcgcttcccttcacatttttgatatctgtcagattggactgatcctccagtgtagcggactggtttttattgatcagatgatcggtgacaatggtatcatacacacttcccgttgcatcggaaataaggtaaacattttcatcttttccgatttctttatcactgacagatacctgaagcagatcctcaatatcatccttcttatcggaagaatcctctttctgctctgtctgaactgcagcatctttcttctgatctgcctgcacggcaactgctgtcatgctgcttccaagaagtgcaatggtcagcacacctgccacaatacggactacatatttatttttcaatctggtttttaactctgataatttcataattccatcctcctatttgattttgttgcgaaatcctgcacttgatgcacagatcacacggtcaaataccatgaacatgcttggcagaataaagattacgacaatcatactgatgatcgcaccacgtgccatcagcatacataatgaaccgatcatatcgatgttggaatataatcctacaccaaacgttgctgcaaagaaactgagcgcactgacaatgatcgactgaatggacttgctcaatgcatcggtaattgcttctttcttatccataccgcggaaacggttcttcttatacttgttcgtcataagaattgcataatcgaccgtagctcccagctgtatggttccgattacaatggatgcaataaacggcaacaccgttcctgtatatgccggaatccccatattgatgaaaattgcaaattcaataacacataccagaatgattggaagtgaaatggacttaaatgtcagtaaaataataataaaaatagctgcaatagaaataatacttacatttttgaaatccacatcggtaatctcaatcagatccttggtacatggcgcctcaccgatcagcattgcggtattatcgtattttttaataatcgcattgatctcatcacactgtttatttacttcatccgttgcagatgcatattccgaaacaatgaccatcatctggtaatctccactcttgaagatatccttcacatcgtccggaatgacatcctgcggaaccatcggtccggtcagggaatccatcgaaaccgcaagttttacaccgtctacttttttgatctcatcgatcatattcatactgtctttttcagacagactgctttttgccagaaccatgtgggttgcacccatatgatactgttcggacagcttatcatttccgactttactgctgaaagtctccggcagcgtaccagtcagatcataatatacattggtatgtgtatatccgtagattgccggaatcagcacaaccagaaacgcaatgacaaataccacatgatgttttgtgataaaccctgcaattctactaagatccggaagaattactttatgtctggtcttttcgattgccttatcgcagacaagaatcagggacggaagaatcgttacacatccgataacgccaaagacaacgccctttgccataacgataccaaggtcttttccaagggtaaagctcataaaacacagtgcgataaatccggcaactgttgtaatggagctgctgaccacggaagtaatggtattggaaatcgcatgtgccatggcacggtttttatctccgtcaaaccgctccttctgctcctgataactgtgccacaggaaaatggaataatccattgtaacaccgagctgcagtaccgccgccagtgccttggtaatataagaaatctccccgaaaaatacgttggaacccagattgtaaataattgccatgccgatactgatcaaaaacaggaacggaacaactacggaatccatcgtaagtgataatacgatcagagaaagcacaacggcaatcagaacatagatcacactctcattctctgccagttttcggatatcattgttcaccgatgccataccactgacaaaacactgctttccaaccagatcattgatcgtctggatcgcatccatggtgccgtccgacgacatggactcatcaaacaggactgccatcagctggctgtctgcgtctttgttattgaaaaagttgtagatatcatccggaagtgcttctcttggaatactaaaatccataacggaaccataccagataacattttttacatgaggtacatcctcaatcttatctgctattttctgcagatccttatcctgcattccctcaacaactacaaaagagaacgcgcctgttccaaattcatccagaaggatatcctgccctttcatcgtttcaatctgtcccggcagataggacaaaatgtcataattaattctggttttcatatagccgatcgcggatggaatcagcagtaaaaaagccaggatcaaaatcagaaaccgacatttaacgactccttttccaaatttaatcatttttttcaccatcctctatttttctctcagcctatcataaaaaaaaagaccgaatatgaaaatattcaatcttttcgtcatgtactgcatgattatacattttgagtgatttgtatgaattcgtatacaaatcattcaaaatgtcatcgcatattctttttataattctttgatgatgtcggtcagagaccgggtcagcatatactgatatgcttcggccatttcgcgcggcgagatgatcattcccatactgatccattcctctgttgcaaaacacatggactgtgcataataggaagatatcacctccggcgtcagccatttgtgttttgaaacccttccgctgctttcgttttgaatcagttcaagcaatacttcccgcacacatttttttgcgatatcgtgaaatttgaccggtccctccatttttaccagctgtgaataaaatgccttgtccttttcaatgttggtaaacagcagaaccattgcttctataatcatatcattccggatcagaggttctaccggctctaacagttctgtccggatgatccattcaataagctcaaatttatcctgaaaatgattgtaaaacgttggccggatgacccctgctttatcagttatctctttaattgtaattttttctaccggccgcctgacagcaatctctttcaaactttttgcaagcagctggtcaatatcggttttgccctgtattgccatttcgtctgttatccttattcgtcaaattccatggtcacaaagtaccctttttctgtctccttcacatcaatcacatcgccttcccggctttttaaacgttcgcctaccgcataatttcccgacattgctattgcatgctcaatggtataataataggaagtgggaagttttccctctgtcaccttcagatgatcccctactttggtcagtcccggacgttccattttaaattccatctgtctcatcacggtcaccttcattttccacaaactctgtatcaacagtctctgtgcgccgtctgtaatccctcgctgcacgcgttgctgtgacagcaatccacagattcagcgctccgttgataatcagcacgattcctaccagcataataaactgtttcaatactccaagcggacagaaaacacagaccagaccgcagaccagacagatgatagcaaatacaagatccatgccccacttttcatatccgtattttttggcattcacagcctccgtcaccgcacgaattccatgaaatacaagtcctacacccaatataaccggaaccagactgacaatcagcgacggctggatgagaaaccagattccaactgcaagtaccagaattccgacaatcgttgatgctccaaatgttgcaaggctcaaaataaagcttcccagataaataattccaacgatgatcattgcaaccgaaagaattgttccgatcacatcaatgactccgcctttccacacaacaaaaataattccaagcacaatacacaaaacagaagaaagcagataatccgcctttgcccgcttcaaaaattctctcatgaaatgatgcccccttttgaaatatcttttgcaacattataacatttccttttttattgttcaacttttcctctaaaaatgatatactgtgcgcggaggtgaatatcatgggaaaagaagtaaaaaccaatgccgtgcgtattctggaacgaaataaggttccctatgaactgctgacttatgaatgtgacgaatttatagatggaattcattctgccgaagccactggcaccccggttgcccagacttacaagacacttgtcatgcagggcaaaagcaaaaaatactacgtatttgtcattccgattgccgaagaggttgatctgaaagctgccgcgcgtgcagtttccgagaaatccgtagaaatgatccatgtcaaagatttaactgcaatcactggttatgtccgtggaggctgcagtcctcttggcatgaaaaaagcatttccaaccgttatcgatgcctctgccaggcaatattctgaaatttatgtaagcggcggccgtatcggaaccagcatccggcttgaccctcaggatctggcacgggttgtccgcgctacttttgcggatattcttgccagaccataaaaagaaaagtgtgccagatttatttccctgacacactttttcttttaattttcgcccggctgccggataatatccagcacacgctgcaactcggctccctctgccggagcctctccatagtcaacatgcttccagtcttttttgaattctccaagcagatgttttcccggatcctgggtccgttcaatcgtaaaatatctgccctcctgcgtttcgtcattccatgcaaaatatacacggaaacaggatggaactcccatatcgcgtaccggcagatccacacggacaatcagtaaactgtcggacaaatccataaccataacggagaaatcttccggcagatacggatacatacgtttctgctgataacattcctcaaaaaactgatccatatattcttctttcttctcacagaggtcatccatcatctgtttgccctgcgcaaaaaagcgctttggcataaaaccaaattcaaactgcttacgttcaaacaacagatactgttcctgtgtaagctgcatcttctttggctgcgctccctcttgacgcttcttttccacttcctcgattttttccaccagtgcacgtttaaaaatcagattctgtgtgaatggattgatcactattccggataccttttcatcctgctgaaaaaccatgttattcgttgcaaggaacggcatgtttataactgcttcactcctcggagattccggaatctcctttttacttgtataaattggaagaaacattccgtttttcggactgttgatcagacacggaaccggcttcttttcatcatttaaatttgccggaacaagcacacgtctggttcgcatcagctcgatcagggcatttaaattctcaccggttttttctttcagatatagatctatctgtgcttccacatcttcattttttacatcaagtgtcatgcttggatctgttggttcctcctgcttgagatcctgcttcttcatgacatcttttaacttctttttgtcgatcatctgtgtatatctcctaaccccatgctgtcggtattgtacaggtcaatccctgtgctcatgatataaaagcattttagcacatattttcaagagattccatacctttatacggtttttgaatcatcaagcgttttctggatcagtttatcaagtcttcttccgatcctggcatatttttcaatgcggcgttccatttccggcggaactccttttttgtaagaaacccggttatccattcctgcccacgcatccatgatcatcgtccgcagctgcaattccacacgaaccacagttgtctttcctttgtaagacatcgggatatccagaacgatatggtaactctcatacccatttttctttggttttcgaatgtaatcttttgcctttactacggtatatgtgtctgtttttccgatctgccgcgcaatccagtagatttccttgacactgtagcagatacagcggaccccggaaatatcgtttagtgcagtaactgcggtatcaaaatccacgtcataatccttgcgctgcagcttttctgcaatgctctccggcgtcttcatccgtgtttcgataaaacgtacaaatccctgtcctgttttttcttcatattcccggttcagttcccgcagccggtttaccacaatctctcttgccagtgcatgttttctttgaaaattatcatcttcccagtgcttccggagtttttctaattcatccataacttaccttccctgctttctgttatatctatcctattctattctccacttttctacaggataacaggggcatgtaaatacagacttcttccctatgtaaattgtttgtaaaaactatgtggtgagaatctttttttccacaagcattttaacaaattcccgatcccggaaactccatggctgcgtcgcacagaacggttcattcccatcgataatctcctgtgcggttgcccactccagatgaaatcctttctcgatctcgctttcggtcatgtgcgtctgtgtcatttcttcttttgcatcacagaaaaaaaagcaggagtgacagacatagatcttgtttttttcaaacagatctcgccgccgctccacaatttctccaatcggacggatggattccggaatcacaataagcccggactcctcccccacttcacgaatcagtgcatcttccagcttctcgcccggttccacacctccgccgagaattttataatctccggcactgccatgttgtgttgcaatttttccatcacgaataatcacgccgcgtgtcgagtatttttcgaacacgggcattccctcttcataatcttttttatctaatgttaaaagtatctgcacggcatttctcctttgctgttccgacatacaattttgtatcattatagcactatcatgggggtttgtgcagatgttttaaatataagtttttctcaatgtgacgaatttgtgcgagtgttttaaatataagttttctcaatgtgacggaagaagggggacattctctttctacagaaaaatttgcaaattagcgccgatattgatttcaggttggtttagcaaaagttttacttttatgctattagctttatatgatggaactacggcgcagttgtaaatttgttcttccgaaagaaatgtcccccttcttcctgtggattggagaaaatatagttgagaaatatatttccgcaaatcctgtctgtggaacaaatatacagccaccttcagtaaaaaatgtcatcgtggtatctatgccaataaaattcatgtaaaagataccattgtggtacctacacgctgaaaatttaacattcagataccggaaggtctctatagatcaaaaattacttttccagatacctctttttctaaaaaaccggtatctggaaaagcaatttttactatataggtgacattttctaatttcaaacatttaaatttcggaaaaccgtcacctaaaactttaatttttcgtctatagatacccggccttatcattgagtgatttaacagggtatttttatgtttattccagttcatgggattcgtagctgtttttgaggcgtccctttaactgcaggctctggtgcctttatatttgtcacacagacaggatttgcgggcatcattcttttacttatggttttccaatccacaggaaggagggggacatttctttcggaagaacaaatttgcaactgcgccgtagttccatcatgtaacgttaatagcataaaagtaaaacctttgccaaaccaacctgaaatcaacatcggcgctgacttgtaaatttttctgtagaaagagaatgtccccctccttccgtcgcatagagaaaccttatatctaaaacaactcccccgcaaatccgtcccacttgccaaacccaaaggctcccagaccccgcagttaaccagcaatttataaagttttgagatactccacaatacttgtcacactgttggcaccatccgccaccgcggtcacaatctgacgcagcttcttggtgcggacatctcctgccacaaaaagccccggctgctccgtcaccccgtcttctccggcacgcacatagccatgatctaaatccagcacagaagccaccgcatcggtctgcggattcataccgactgcgataaagataccgctgaccggcagttctttttcttctcctgttccggtgtttgcaattaccagatgatcgaccatctgctccccacagatttctttcaccacggtatccggcaggaaggtgatcttcggctcatttgccacctgttcctgcagtaccttcgtgccacgcagttcctgtctgcggtgaatcagatacactttttcacatccggctgccagatacagggcatcttccagtgccacatctccaccgccgacaaccgccactgtcttgttacggaaaaaagctccatcacaggttgcacagtaagacaccccggctcctgccagtgtttcttctcccggcaccccgagtttccggtgtccggctccggttgccagcagtaccgtttttgtctcatagacggttccggaagcaccggtgattttccacgttccgtctgtatttttctctacgttatccacttcatcgctgatgaacggaacctccagtgcttttgcatgctgctcaaatttctgtgccagatcaaacccattggtttccggcagtcccagataattatcaacttcctgcgtataaatcatctgtccgccacccatcggctctttctctaaaacaaccacatccagacaggcacgctttgcgtaaacagctgccgaaagacctgccggaccgcttcctataatgactaaatcgtacatgttattcctcctgattttcaaaaaaatctatttcataaataatggcatttttattctttcctattttaccatacccctatacaatgcgctattttcttttctccaataataacaaaatatgctccttttacaaaaattttacgtgatttggggttgaaaaatccatttacaaatgctaccataaccaaggatttaaatccacaatcataaaaatctgagtaatggaggtgaaattcatggacagtagcgatagttttgggcgaagtagacattttaataccgatgcttttttcactggcaaaattatcgttttcactggaaaatgaattttgccgattcatgatgtttaaagcaccggtaggtgctttttttgtgcctgaatatataaaactgtatacctgagcccttttctattgtgcatatccgcagcatgatgtagcttttgttgcacatgatgactgcacacaaggaaaggagaattcatatgaacaagaaatatttagagcttacaaagctgatccgaagcaaacaaaatgaccatgaaatcttaaaatgcttatctaattatcacgaaaacgacattgccgatatgcttacggttatgactccaaaagaaaggaaacgtatttatacgcttctggggccacagaaaattgcggaaatcttcgcatatctggatgaaccacaaatctacttttccgaactctccgtcaaagatgccgccaaagtagtttccctgatggattccgatgatgccgttgacgtcctcgaaacactcgacgataaaaagaaatatgaaatcgtggaaaacctggacaaagctgccataaaagatgtaaaaatgctgctttcctatgacgatgacgaaatcggaagctgcatgacaaccaactacatctgcattccaaagggactttccgtccgtcaggcaatgagcgaactggtccgtcaggccggaaccaatgacaatatttcaaccatttatgtactggatgaatccctgaaatttgccggtgctattgatctgaaagatcttattattgcaagaaaacatgatgtgcttgacgatattatcgtccgctcctatccatcggtaaccgatcacgaaaaaattgatgactgcatggaaaaaatcatggattattcggaagattccattcctgtcctgtcgcaggacggtcatatgctcggtgttattacatccgaagatatcgtagagatggttgacaatgagatgggggaagattacgcaaaactggccggcctcaccgccgaagaagatctcaaagaaaccacggcacaaagcatgaaaaaacgtctcccatggctcatcatcctgctgttccttgggatgatcgtttcctctgttgtaggtgtctttgagcatgttgtggctgtacttccgatcgtaatctgtttccagtcccttgtgcttgacatggccgggaacgtcggtacccagtctctggcagttaccatccgtgtcctgatggatgaaacactcaccggaaaacaaaaacttttcttactggtaaaagaaatgaaaattggtcttttaaatggtggaatccttggtattatggcacttgcactgcttggcatctacatccacctgtttaagggatacacctggatcggagcatttggcatctctggctgcgtcggcatctcgcttctcgtggcaatggtgatctcaagcctcgtaggtactgtgattcccatgtttttccataagataaaaattgatcctgcggttgcatccggtccactcattacaaccgtcaatgaccttgtggctgttgtgacttattacggtctggcatttttgttactgatcatgtaaaaatataatctttgcaccatactaccgaaaaatgctgcctgacaacaatatgttacaggcagcatttctattcaacaatttctaagctgcataggagatatcgcttacgcgagataccccagatagaaaatctatccgcagacggataccctttactgaataaccagttcttcaatcgtcacatttttctctttgtcaatgtcaaaagctttaagcaccggctgatccatatccatcagggaaagaatcaggtaattgaccgtcggatcatatgccagacgcttatcttcctcggacgggcgtgacggcgattccggatgggaatgccagttgccaagcggtaccagatggtttgtgcgcatatctttaactgcggcaagctgttccttcgggttcatggaaaaatgctcattggtgtgatccacattttccagaaggtacaccttctcgatgatctttttgtctccgtctttggtgcctgcaatcagaccacatgcctcttccggaaggttttccttcgcatgagctaagattttttcatagtctgcttttttcatggtaagcataaaattttcctccttttcaaggagcaaatcgcatataaagtctgcttcgcagaggcgatttgcgtaggagatatcgcttacgcgatacctcatgtagagcagttcgcatataaaagtccgcttcgcggaggcgaactgcgtaggagatatcgcttacgcgatacctcaatgatccgggcactcgatctgctcgtaatcaatcagttctgtgatggtcggatgatcgccacagattgcacacttatgatctgcctttggcagtttgatcgtgtggaattccatctttaacgcatcaaaagtcagaagctttccggttaagagatcgccaacaccgatcaggtacttgatggcttccatcgcctgtaaggatccgatgacaccgcccattgcgccgatgacacctgcctgcttacaggtcggaactgcatcctttggtggtggattcttgaatacacaacgatagcatggtccttctcccggaacataggtcatgagctgacccttgaaacggatgattcctgcatgggaaaatggcttctttgccattacacaggcatcgttgattaagaattttgccgggaagttatcggttccatcaatgatgaaatcataatctttaatgagatccataatattttcagaagtaacgaactcacggtatgtatttacggttacatccgggttcattgcgttcatggtctcttttgcagattttacttttgcttttcctacatctgcggtgccgtgaatgatctgacgctgtaagttggacagatccacttcatctgcatcgacaataccgatggttcccacaccggctgcggcaagatacattgctgccggtgcaccgagtccgcctgcaccgataatcaaaacttttccgttaaggagctttttctgtcccttcacaccaacctcctgcaggatgatgtgacggctgtaacgctccatctgttcattggtaaatgccattagaagcttcctcctcccatgaagtataagaattcaactacatcgttttcctttaatgttacgtttgcaagatcgtgattttctacgaaatcatcgtttacggtaacggtcacatattccggattttcaaccttctcgtcaacaacgagctgtgccagcgtggttccctctttgatgtcttttacgtttcctgcgattgttactttcatcggtaactcctcctaaatatattttttcacaatttcttccagttccggcttcttaatcagaccgcgcacacgctctgcttcctttccatctttgaaaaacaggatggtcggagaaaccataacggaatactgttctgccagttccccgtcaaaatttgcattgactttgaccacttttaagcgatcctcataatcatcttcgatatcgccaagaatcggtgacatctgtttgcacggaatgcaggaatcggaataaaactccaccagtaccggtacagaagcctgcaaaacctccgcttcaaaattatctttacttactcttgctgccatgcgcttaacctctcttgtctactcttcgagtttctttacaataaggtcataagttccatcttcattgtcgatcagctttaatacctgctgtccctcttccttgaaacttctcggtacgttctgcaccggctctccatcattcatatgtacggaaatcacctgtccgatctctaactcttccatggccacctttgccttgacaaacgtcatcgggcagaccacatccgtaatatctacagtttcatcaattgtaaaatcagccattgtatgcctcctttatcttctcttcaaatttatcaagtcccactctctcgagtgtcatgcggaaacgctctcctggattggcattgtcatcaaagaactggattgccgcatcggtaatgcggaataactgttcctcggatgtcacaagcggaagataattctcgcctttgtatacgcggtttccaaacagtccaccgaaagatacctcaaatgcaggtgtcgctttccatgcatcggtcggacaggcctttacacagcgtccgcagttgttacatttttcctcatcgagaacgatttttccgtccacggtgctgattgcatccacgcggcaggtcttctcacagatcccacagttgatgcaggctgcttcctcccattccacaatggatgcacccttgattccgacatcattttcttctgcctttaagcagttgttctggcatccggttacaccaaatttaaacttatgcggaagttctcttgcaaaataacgctcatccagtttttttgcaatatcataactgtcaatatttccactagggcataccgccgatccctgacaggctgtaatcgtacggacacgcggtccacacacacccggcttacatcccccggttgccagcacttccttaacttcttctacatcgtcaagtttgataaatgggatttccacactctgacgggaagtcagatgtacgtgtccgtctccgtatttttctgcaacctttgcgataatctgtaaattctctgctgtaagatttccacctaccacagccagccgcagggaaaaattatttttttgtttctggcgcataaatccgccttttttcaatgtagcataatcaacagccattactctctcctttaaaccttgtgtatttttctttgtttatccggcggtattttggattgctgctgtaaaatcctgcttcagatcttcgatatcctcaataccgacacttattcttatcatatcatcaaatacggcggcgtcaatcttttcctgctcggttgagtgtgccgccagtgtggattccggatgtacgatcagtgtcttggtatctccgatattggatacgatctgcggaatggtcagcgcattcatgattgcaaaagcgcgttccttgcttcccacgcgaatggttaaaattgctccaaatcttccatccagcaactgctttgccacaccgttccacggacttgatgcaagtcccggatagtttacgctgattcccggaatggtttccagataagccgcaagctgcattgcgttgtcacacgcccgctccatacgaagccccagtgtctccataccaagcagattatagtatgcagtctgcggcgccatacaggctcccatgttgcggaacaatccgtttctcagttttgcagtaaaggcaaattttgcaaactttttatagtctttcatgcccggataccgctccagatcccatttgaatcttcccgcatcggtgatcacaccactgatggcactgctgttgccgttgatgtatttggatgtggaattgatcacgatgtctgcgccaagttcgagcggacgaacgagaaacgcggtagctaccgtattatcgatcatgagcggaagattgtgccgctttgcgatccctgcaagtgccgggatgtcggtcacatccagctttggattgccaatcgtctccgcgaagatgactctcgtcttatccgtgatcttggattcgagatctgccagatcattcgtatctgcaaaaattgttgtaatcccaaacgcttccagatcgtggtaaagatcaatcgttcctccatacaggctggtgcttgtgatgatctcatcaccacttcctacgatattcagaagggcattggtaattgccgccatgccggatgcacaggcaacggatgccacacctttttccagaaccgtcatgcgttcttcaaatgctgcgatggtcgggttattgattctcgtgtaagaatatccagcagctttgttgtgaaacagcttctcatgctgctctgccgatggctgaaagaaagcactggactggtacaccggggtaagtgtggctccggtcaccggatctccggtttttgtaccatgtagtagttctgtgttgaatcccatttcatttcccctaattcatacttatctaataggtttaatatgttatagttaatataccgcaatcataccctattgtcaaccttttatttccacttatttttccatcaaaaaaatccccgctggttaaaaccagcagggattccattctcataataaaatgattattctgtccagtgctcatccttaaatacgatgcggcggtaagtctcaaaatcaacccacttattaaagaagttctcagagatctcactgccctctgcggaaagctccttcttgaacgcatccacatctgcggcacttgttacatgaactgcaaatccacggccgttgatgataggcacatcgttgtatgcaaagtcagcaagcggaataattgcagtaaccttctggtcacggatggataccgctacctgctcacgcagaacaaccacatcaaagctgtccggatactgatacgtctcacccttgaccggaatcacatcaccgatcgtgtaagttttatcggaaggctgtaccttaaagacgttcatagcctcaaggtcatagtaatattcctcgaagatatctccgtttgccttgagatttccgtgggcaaatgcgcattttaagtccttggtctcatcgagcgttggattttccacaacaccacatgcggaagtcatgttggaaatacggtcgatcaggatcagttctcccaatgtcttatgctttgcaaaagcatcaatgacgatctcttcctgcaataccagatcgcagaccgcaatctcgttcttgcgcaggcggccaaccggaataaattcaccggtgttgacatcaatcttgtactggatattctttaagatacccggaatcgtacgtgtaccgagttttacgagataatctttgccgacggtcagttcctcatcgtccatccagaggattgttgcggtaaatttcttgctgaccggaagcttcgtatcttttgcgagaacacatccgcgggatacatccacttccttgtcaagctggatggtaactggacggcctgcatctgcagtctgtgcatctttatctccgactaaaatgctctttacttttgcatgctcattgcttggcagagtcacgattgtatcaccgaccgatacagcgccactctcgatctgtccctggaaaccacggaacgtgtgatccggacggcagacacgctgtaccggcatatagaagccttcttcctgcttcttttcgctcacatcgatattctctaagtaagcaagcagtggctcctgcgtgtaccatggcatattgtcggaatgggtggtgacattgtcaccctcggttgcagataccggaatgatcttgacacttgctaaatgcagttccttggaaagttcctgaatctggtcaacgatctccttgaaacgctcctcgctgtaatcgacaagatccatcttatttacagcaaatacaaaataacggattcccatcagtgcacagattctggcatgtcttctggtctgtacgagcacgccctgctttgcatccacaaggataacggcaaggtctgcaaaggatgcaccgactgccatgtttcttgtgtactcctcatgtcccggagtatctgccacgataaagcttctcttttcggttgtaaagtaacggtatgccacatcaatggtgataccctgttcacgctctgccatcagtccgtccagaaggagggagtaatcgattgcgccgccgcggcttcctactttggaatccagctccaacgctttctcctgatctgcgtaaagcagtttggaatcgtataaaatatgtccgatcagtgtggactttccatcgtctacactaccgcaggtaataaatttcaataatccgctcattttagaaataaccctccctctttcttcgttccatgctgccggctgcctcgttgtcaatgacacgggtggtccgctcagactctacagcactcaaggtctcgtcaataatctcatctaatgtggtcgcgttggattcgattccaccggtcagtggatagcatcccaaagtacggaaacgcacattcttgtattcaattttctcacccggacgaagtttcagacgatcatcatccaccatgataatctgtccgtcacgctcaatcaccggacgctttgctgcaaaatacagcggcacgatatcgatgttttctctctttatgtactcccagatatccgtctccgtccagttggaaatcgggaacacacgaatactctcacccttgttgatcttggagttataaagtttccacatctccggtctctggttcttcgggtcccatgcatgattctcattacggaaagagaaaattctctcttttgcacgggatttttcctcatcacgacgtccgccgccgaatgctgcagtaaatccgtatttattcaacgcctgttttaatgcctgtgtcttcatgatgtcggtgtactggctgccgtaatcaaacggattgatgccacgttttacaccgtcctcgttgatatactcgatcatgttaatcccaagtttctttgccgtctcatcacggaactgaatcatttccttgaatttccatgtcgtgttcacatgtaaaaatgggaatggcggcttctccggataaaatgctttcatggcaagatgaagcattaccgaactgtcctttcctatggaataaagcattactggtttttcacactctgccgctacctcacggataatgtagattgcttccgcttcgagtgcatcaagatgagataattgactcatgatcttcctccttaatatttattcgaatcctttttattcacaacaattgtttctattgtaccatccgtttttttaattcgccagtgtaacagatctccttccgtatgaacggtcatctggcttcccatgccgccgatgtcggcacccaggtaataggaaattgcctcaaacggacactccttgatacaggaggcgcatccccagcagtccttcggataccggatcacggcttttttgtcttcgccgcgcacgatcaggcttcccggacagacatccagacattttccacatgccctgcatttcatggaatcaatcgcgatgctcataggtttctcctcctttcaccagatctctgcggatcatcgtaatctggtccccgttctttttcgagtttacatagcagagccatgcatcactcttctccggataatccagattctccgcgaaactgtgccagcgtgtctccttgcgtgcacgcagatgtgcgatcacagtcaggcacacggtcaggcgttctttcagctcatagataaacatcagctcatgcatatcggctgccgcaagtccttttgcaaggatctgcagtttctttattttttcttccgccatggcaagctgcttttcgttgaactggtaatgggttccgattccgcctgcatactggtccatgactttctgcatggcttcctcgagttcctcaacggtaaatgccgggtcctgctttgtgagaaatgcatcatactcggcaattttattttcaagaaccgcttcttcatcagaagccgccgtatctgccacctgttcttcgtttaatttctgcacgatggaatgggctgcgatctcgccctccaccagtgcgccggttacatatttctgtggacagccgcctgccacatctccggcagcatagagtccgtggatcgttgtctctcgttcggtgtctacccagtaaccgctggcggtatgaccacctacgatatacggctcggttccctcgatttccacgttctgttcgcttggatttttccccgattccacccacttgagtgtctgtcccggcgccatgtttaagtatgcttttaagagcgattcatcctgttctgcggagatgccttcggtgcgaagataacatggtccgcgtccctgtacattttcttcaacagttccgtacacacgctgggaagtagtcagaccgtattttgtctcatacacttctccgtgtgcgttgatctgctttgctccgacaccctgtgcaatcgttccggtcggagcgatcgtatctttacagcgcagggcgataaagcgcatctcaaatgtggtcatctcggctccggcttcaattcccatggcatatccggcaccggtgttaaacggcggataccacattttatgacgggaaaaacccggattgttcgggcggtaaagtcctgcggctcctccggttgcgatcagcactttttttgcgcggatctcgtaggccgtaccgtctgcaatggaaaaaccgacggctccttcgatcttattattgtttaccagataatcggtaatgtttaactggttgatgacggtcacatcgtctaatttgctgacagcatctgcaagaagcggcttgaagttttcgccgttgatcttgatattgcggtttcctcttgccacatactcgccgttttcgtcttttaagatgaccagaccaagctgttccattttggcggtcacacggttgagtccttcggacatggtcaaaagcagatccggccggacgatgccgtcggcatcttttgtggcgtagtccacgtaatcctgcggaacatgacctttggtgatataggcattgagcgcgttgactccggctgccagacagccgctgcgcctgatgttggctttttctgctatgattatggaataatcggattgttcacggatggtcattgccgcgtagcagcctgctgtgccgccgccgatgatgaggacatccgtatggagtattttttttccctcgattttcataagtaatccttccttgtgattaaatgtagaagacctcgccttcctgcatctctctattttctacgagataggtctggttttcatcaaatatgtaaagccggtagattaagacatacactttttcaccgatctctaccggatctttttcaagtgagcgctcggtgacgatcgggatacctcccacatcaacgacaacatccagatgatttcctcggaatatcacatcttttacgattccacgctcggcggcactcatatgctgcggtggctcgcttctggacatgcggacaaattccggacggataactgcgtgggttgcgccctcgaccggatcaaatccaagcagacgctcataatgctctacgatcgaggaacggccgataaactgtgccacgaacggggtgtccggtgatttataaatttccatcggtgttcccatctgctcgatatgtccatggtttgtgatgataatctcatcggccacctcgacggcttcatcctgatcatgggtaacaaaaatgcttgtaatgccaagctttacaaccatctcgcgaagccagttgcgaagttcagtgcggacttttgcatcgattgccgcaaacggctcatcgagaagaagtacctgcggattcggtgccagtgcgcgggcaaatgccactcgctgacgctgcccaccggacaactggttcggataacgcttttccattccgcttaatccggtcagttccaacagttcggtcacgcgctttttgatttcttttttcggcaccttggcaagttcgagaccaaaagctacgttgtcgtagacggtcatataacggaacaatgcatagttctgaaagacaaaaccgatgcctcgttttgccgccggcacatcgttgacacgctgcccgtcaatatagatatcgccgctgtttggtgtctcaagccccgcgatcatgcgaagcagtgtggtctttccgcttccggaaggtccaagcagtgcgactaattttcctttttcaatgccaaagctgacatggtcggaagcccggaagtttccgtaatttttacaaatatctctcatttccacgtacatagcctgactccttactgtatccctttactgtttttgcttctgtattcaaaaatgtttctgagtatcagcacgatcaccgcaataatgaccagaatggaagatactgcaaatgcggaggtgatggaagtatccgtccccgacatatataaggcatcaatctccagcggcagggtaaatgtctgccctctggtctttgagagtgcattgactgctccaaactcgcctaacgcacgcgccgtacataaaatgataccatagatcagtccccatttcatctggggaagggtaattttccggaaaatcgtaaatcccccggctcccatcaatgctgcagcctcttcttcgtctttgccctgtgcatttaagatcgggatgatctcacgcgatacaaacgggaaagtgacaaaaattgtggcaagcaccacacccggtaacgcaaacgtaatgcggatgtttgttccgaaaaactggttgatcgcccggattgccggatacgtccagccgagtcgtccgaaggtcatcaaaaaggcaagacctacaatgacgggagagatcgaaaacgggatatcgatcagcgtggcaagcacctgtttcccacggaaagaaaactttgtcagaagccatgccgccatgattccgaaaaacgtattgacaactaccgcgatcacagttgcaagcaatgtaaccaaaagagccgaacgcacatattcggttgtgaccgcctgcagataaaaagcaaatccttctttcaatgcactgaagagaatcgaaaacaggggaagaatcagcataacaaatatgaaaagaacgctgatggctattaagatgtatttcgtacttttcttttgttccataaaaacgaacttcctttcttaaaacaaactggctggtttcccgttgtacttacacattgttggttctggctgcctgtttcatctgtacgatattcacagcaagcagtaaaacaaacgataaaatcaacattaccagcgcgattgccgtggcactcgcataatcaatatacccaagcttctgcatgatcacataggagatcacctgcgtatgttcccttgcactgtttccggatatgtaaatgacacttccgtactcaccaatccctctggcaaaggcaagcccaaatccggttaaaaccgggggcatcatctccggcagaagcactctgcggaaggtctgaaaccggttggctccaagcataaatgccgcttcctcatactgtccgtcgagtttttcaagcaccggctgcacggcacggatgacaaacggaattccgacaaacaccagtgcaatgaccagtcccagatgtgtgtaggatactttgatgccaagttttgcaagcggagtcccaaggattccgttttcggaatacattttagaaagtgtgatacctgctaccgaagtcggcagtgcaaacggaagctcaatacagccatcgaggatacgttttcccggaaactcatatcttacaagcacccaggcaatgatcacaccgaacacactgtttataagtgccgcaataaacgaacatccgatgctggtcgcaaatgcatgccgcacggtcggcttcgtgatcagggaccagaactctgccggacgcagttttaatgcggaaaccatcacagatgccagcgggatcagcacaatcagggaaagcattgtcactgtaattcccaatgtgaggtgataccccggtatcacgcgtactttttttgtcttattcgttgccgtagatttcatcaaacattgctccatcgtcaaaatagttcttatatgtttcgttccagccgccgtaatctttgatcgtatataatttcacattcaggtcaaaacggtcggaaaattctttcaggattgattcattgctcgggcggtatccatattctgccaccagccgctgggcatcatccgtgtacagataattcaaatattccctgctgacttcctgcgtgccgttggcatccgcattgtcatccacaaccgccacactcggctgtgccagaatactgacactcggcgtaatcatctcatattcatccggataacttttcatcgtggtaattgcctcattttcccacgcgatcagcacatcccctttctggttttccacaaatgtggtagtggaaccgcgtgctccggaatccatgacggaaacctgcgagtaaagtttctgcagaaatgctttctgttccttctcatcatcggtctgctcctttatataggaaagtgctgctaaaaagttccagcaggcaccaccactgctcttcgggtccggggtgatgatctcgacctttttatttaccagatcgtcccagtctttgatctgtttcggattgcctttccggacgaggaaaacaatcgtcgaagtgtatggggaactgtcatcggcaaattcctgttcccagccgttttcaatcagtccggtctgctcgatcagtgtgatatcatgctcaagtgccagtgtcacgacatcggcgttacatccctctacaacggaacgcgcctgtgcaccggaacctccgtgggattgaataatattcacttcttttcccgttttttccttataatatttctcaaacagaggattatatgcttcataaaattctcttgtcggatcgtaggagacgttggtgattgtccgtacatgactctttttgcttccgcatccggtacatccaatcaacaaaattgccgccatggacagtaccgctattttctttaccattgaaaatgattttcgcttcatgctcccgcctcccttgactttcgtttatcataccccttaattcctatcatgtcaataggtattgtaggaataattttcctttctttctacggtaccatggaaagattgaattttgcttgaatctcaatgccgggattttttatggacaattaaattgctggttaactgcgtggtctgggaccttttgagtttcttaaaagggacggatttgcggagattgttctaaatataagttttttcaatgcgacggaagaagggggacattctctttctacagaaaaatttgcaagttagctctggcgttggtttcaggtacgtggagtaaagtttttcagtttgcgcaattcactatgggttgtgagtgccagagcaagttgcaaatttgttcttccgaaagaaatgtcccccttcttcctgttggctggagaaaatataattgagaaacatatttccgcaaatcctgtctgttgaataaatataaaggcaccagaacctgcagttaaaggtgctcccggaaggtaatgcgtgtaatgaatgtttacggtaaagtgataaatgtttgggaaacttaacatgcaaataagtgaaaatttcattgctggtattttgtgaaacaatcgttctattgaagcttttatatgatcaggcattatgaatttataaatgaaagatgggggctatataatcaaaattcataggaaaaatgccatcgtggtatctatgcaaataaaattccgtaaaaaattccaccgtggtatctatgcaaataaaattcacgtaaaagataccattgcggtacctatatattgaaaatttaatattcagataccggaaagtctctatagatcaaaaattgcttctccaggtaccgctttttctaaaaaaccggtatctggagaaacaatttttactatataggtgacatttcctgattttaaaccttaaaatttcggaaaactgtcacctaaacctttaatttttcatctatagatacccggccgtatcatcaagtgatttaacagggtatttttatgcttattccagttcatgggattcgtagctgcttttgaggcatccctttaactgctggttctggtgcctttatatttgtcacatagacaggatttgcgggcatcattcttttacttatagttttccaatccacaggaagaagggggacatttctttcggaagaacaaatttacaactgcgccgtagttccatcatgtaacgctaatagcataaaagtaaaacttttgcaaaaccagcctgaaatcaacatcggcgctaacttataaatttttctgtagaaagagaatgtcccccttcttccgtcgcatcgaaaaaacttatatttagaacagtccccgcaaatccgtccctctgaaaaacaaaaggccccagaccacgcagttaaccagcaatttatcaaaagaagtttccatcactcttccctggtcaattcatatgtcacctccttgatctttgttcgcataacaatccctctgacatcttccggattaattttatttgccacctgtaatcccagataagaggtcaccctatagaaatctcctgactgtaacactgcattgcagtcggaataggttttctttgcctttgaatcactaatgatatccatcggataaggatctgcaatattccagttacgcgttccatctttgtaaatcaaagaggtttttccaagatcctctcccacactttcctgattctttccccatctctctaagccaaatgaccattcagcatttttctgcatttttctgtaatactctgtagttgttccataaattacagcactcaatggtgttagccgcatccgctttggctcataatacttcgggctgatctgctcctgattttttgctttcaacgtatattcataaacaggaacattacagctcgcgtcaagtgtcgcagtattattcgttcttgtaggcaaatcataacacaatgtcaaattcattgacgatggaatccattgtcgaaaatccatgtccattgcaaaatactgcacattcttatcactttgtgttctgagataaatagatgaagattcaaaacgctcttcatacacgttctgctcaagacgcaactgtcttttcgaacgaagatttccattttcatcatagctctccgatcccgccggtcctttggttgccagccatttttctccggtttcatcctttgcctcatagcgcacaactgcacttacgacaacttcatccgaaaggatttcctctaccgaaaaaatcatatgttcatcctggtcactgaatactcctcttgtaacgtaatcggacaattcacttcgctgtccccaatacccctgaaacatcttttttagctgctccgcaaaagatgtctgtggaacaatgcaggcaagtgccagtgcagccgccacggtacctgcaataccggccattttcattcgtttttttctcatcattttttcctcctttcgtctctttttgagtacaatttcctcctctttgatctcccgctgcggtgtaagggccttttttaaaatcttatctaattgctcatcgttcatatccgataacctccagtttttcctttaaaagtgattttgctttgcgcagacgggttttaacagtattgacggaaagatgcagacactccgcaatttctgtcagtttcatatccgccgaataatacagatacaccaccagccggtatttttcgggaagctgctgcaccagtttctgcacttcatgtattgtttcctcctgcaatacctgtacttccggatctgcattccgggtttccgatgcttccccgccgttttgtatatgtacttcgtagctctcctgtggtgcaatccgcatccgccatgcaaattttcgtctgcgatttttccagagccggattgccacagaaagtgcataacttttactgttatttttctcatccagccggtctaaatgttccagcagcgtaagcatggtatcctgatacagttcatcaccctcatgggcatttcctgcagtcatcctgcaaaaccacaggatatctctcccgtgcgcaagcacaaactcatcaaacttttgttttgtcacgtgtaattcctttctattccccaaagacgtccatgagatttctctcttacataatgatattgtaataaattttcaaaaagttttccggatttattggcacttgaacaaatacgttgaatactctataataagtagaaaacctgtgccctgcggtacatttttaatgtatcccaatcgcatctggctttttattacacattacgaggaaattttatgaaaaaaaataccctgcggcattcccttctgctgcttctgactgcagctatctggggatttgcctttgttgcacagagtgtgggaatggactatgtgcagccttttacctttactgctgcccgctcactgatcggggggatcgtactgcttccgtttatttttatccgggcgcagaaaaccggccggacttctgaggaaaaatccgcttcctggaaacaggcactgcccggaggcatcatctgcggtgttctgctgtgtatcgcatcgaatctgcagcagatcggcatacaatatacgaccgttggaaaaagcgggtttatcacagcaatgtacatcgtgcttgttccggtactcggtatactttttcacaagaaaaccggtatccgcgtgtggatctctgtggcacttgctgtatgcggactgtatcttttatgtatgaccggaggttcctttcgtctgcagcgcggagatctgtatacactctgctgtgcgctcatgttttccctgcagattcttgccgtggatcactatgcaccgatcgcggataatgccatactggcatgcatcgaatttttcacctgcggcatctgttccctgatcccgatgtttttactggaacagccacggatgcacctgattcttgccgcatggctgccgatcctgtatgcaggcatactctccaacggtgtggcctacactctgcagttttttgcacagcggggacttcctgcctctacagcctctctgctaatgagcacggaatccgtgttctcgcttctggcaggttttctcatcctgcaccagatgctgaacggtcgcgagcttgccggatgtgtactgatgtttgccgccattattcttgtacaaataaaaggaaaagaaaaggagtcgattaattcatgaaaaatatcattgaaaacgaagtcggggccatcctgacagatatccttgacgattataaaaaaggacgcgcggttgataagatggatatctacaaccagccggataaaaccgaaattatggacattcttgaccgtctgttttccattgtttatccgggatttttccgcgataaaacccacaaaatctacaatattgaacacagtgtgtctaccatgatcgaagatgtaatgttccacctgaacaaacagatctgtgttgtcttaaaatatacaaaagaatttggggacaatgaggaagaaaaactggaacagtttgcacagaaagcaaccgtttcttttatgcggcggatcccaaaagtccgtgaatacctggagacagatctgcaggctgcctatgacggtgatcctgctgcccgcagcaaagatgagatcgtattttcctatccgggactttatgccatcaccgtataccgtctggcacatgagctgtttctgctgggtgttccgcttatcccgcgtatgatgacggaacaggcacacagcaagaccggtatcgacatccatccgggtgcaaccatcggcaaatatttctttattgaccacggaaccggcatcgtaatcggtgaaacaaccatcatcggctgccatgtcaaactgtatcagggtgttacacttggtgccctttccaccaaaggcggtcagaaactgcgcgatgtgcgtcgtcatccgaccatcggtgacaatgtaacgatttactccggtgcttccatcctcggtggggaaactgtcattgaggagggggttgtaataggtggtaactcatttattacccagtccattaaaaaaggcaccaaggtcagtgtccgcaaccaggaactgatctaccacagtgatgatgaatcacttcaccacaaagaacaggatgaatcctggttttacattatctgatagttacaaaaggggattttatggatacaaaagctttccgggaaggattccgcgatggcattcccatcggacttggatacctcgctgtttctttctctttaggtatttctgcaaaacaggctggtctgactccgcttcaggggttcgtgaccagctttctggaaaatgcatcggccggcgaatacatcgcatttactctgatcggtgccggtgccacatatattgaactgtgtctgatgacaatcatcgccaatgcacgctatcttctgatgagttgtgccatgagccagcggttttcaccggatacccctatgatccaccggtttcttgtcgcatttgacctgacggacgagctgttcggcattgccatcgggcgtcccggatatctcaatccctactacagttacggtgcgtttcttgtcgcacttccgggctggtctatcggaaccgccgccggtgtcatcgccggcaatctgctgccgggtgatatggtaaaagcactcagcgtttctttgtttggtatgtttcttgcaatcatcatcccgcctgccagaaaggacaaagtcgtgctggtgttgatcatcatcagttttgcagcaagttacctgtgcagccgtctcccggtcatccgtgacatttccagcggaacgcgcacgatcatcctgacactgatcatcgctggaatcgccgcatggcgtttccctccgcagacggagatcactccggaaaatgctgacgcacaaaaagaacagggggcaaacgtatgagtggaaacatttatatctacattgccattgtagcgatcaccagttatctgatccgcgtgcttccgctgacgctgatccgcaagccgatcaaaaaccggtttatccgttctttcctgtattatgtaccttatgtcacacttgcggttatgacctttccggcaatcattgatgccacagccacaccacttgcaggagcacttgctctaattgccggcatctttatggcatggaagggactcggacttttcccggttgcgatcgcctgctgcatcatcgcttaccttggcggactgattttttaataaaaaaatgcctgcatcattttttgatccaggcatttttctatccccaaagtgaaaataaaaatactacgattccaagaataacaagaatcacacccgtcacacggttaagtgttttcggtgtggctttatttgcaaataccgcagcaattctcgcccagatcagggtaaaaatcacacacagcgtaaacaccagtccgtccggtttcccgccaataacaaaatgggaagcagcccctgtaaacgcagtaaatgccataataaatacactggttccgactgctgtcttcagttcatacccaagtacagaagtcaggataagaagcatcatcatgccgccgccagcaccgacaaatccacagataaatccgatacagataccgcttatgaccgactggatggcacgcttttgtgcggataccccctgcatggtctctttggttgtcataaccgggcgaacaataaatttgataccaagcaaaaatgtcataaagacagaaaaatttcccattgtggcagatggtacaaggcttgaaacatagcttcccaccacggtaaatgcaaggacactaaccatcatgatcagaccatttttcacatcaagattcttattttttccataggtatacgcagacactgcactggcaagtacatcagaagacagcgcaatcccgaccgccatatacggctccatcccaagaaatgtgataagcatcgggctgataaccgctgccgcactcatcccggcaaaaccggttccaagtccggctcccatacctgcaaaaaatgttactagaatcgtaaataatactttcattctcctgtatctctcctttgttccagataacaagtaattttagcacatttttcaaaacaaatccagcatgttatccagataaatttcttcccggacatgcagctgatattgtggctttgtcatgtaatatagcagaaactctaaaatcagtgcacttccaagtccccgtccctcgatcttaaaattagaaaatcccattggaaagtaaacattttggattgcctctattccaataaatcccggattttgcatggctttggaaaagcaatatccctgctcagattccggtgccgtacagtgatgttccctattttctccaagattcttgcggctgaccgcttcataacaggctttcctgtccttacagccaaaccagcagcattcattgcacaaaaactccaccttgtctttttcttgccaagacagtgtcttccatcggtcataggctttatttaagcgaaaatcaggaacaacataccggaaatcttcacgtcgtatttcctctaccagctgcttaaaatccgtgattacttttgtggtggacgaaacaaaataaaggtgcggataatgttttttcagatattccaacagcagatccgaatggacaatcacaccgttttgcacatctttattttcttccagtaaagcacagagcgcattgcatttccggtcagaaagatgcttctcttttaaaagagagttgctgaaggtcagccgcgcggatattccatactcctgcatcagtgccagaacttctttcggatcattctctccaaaaccggcacgtccgccgccccagatacaatctgccggagctccatagatcgaaccgatttcacaccagtcataaaaccagtccctgtgctcccgatataacggaagaaacacgcggtatagttcataaaattcaaacaagcccggaaggtgataatacgcttttaccattctgtacattcctctcattttttatcataacggttcagaccacctcagaatagttactttattaaatacaaaatcaacccggacatcaccccgattccaataatacagataatcacacctccaatgaccgtcacagttcttccttcatccgataattccgcattctgaaactgccatctgcgcagaaaaaagtataccttatccggataataaatctgtacgattccaagcacataaataaggactcccaataccgtaaatccccaaaatgaaatcgactccagattgccgtaaaggatgtgtcccaatgcattgctgtatgtttcatcactgatgacaggcttttcattccctgatataatctgcatttcatcccagcccacagggcttccatctgccgcgagtaactgatcccccgtccatgtgccgtttatcgtatcatccgcaaatgaaaacgtgacctgatcccctttcatggtataggaaacattctgtttttttccatctgccacaagtaaaaaagtatcatcttttgttcgttcaacatagttgactgtgttgtgcacaaacttatctgcacggactttgtaataaaaatcatccccaataaaaacgccttttcgcagcgtaaaatatccaccgattgcgactgcaaaaatggcaattataatcaaaaaaacaagtcccaaatgctcttggattttcttcatttccgtcctccttctctttaaaaaaaaagccattctctcctgcgaaaatggcttctgaaatactactacttattttcaaaattaacactgcggatcatgttacggttgataaactgtgttccctttttcggtgtctcgatcttcacccactgcgcatccacgtccatcagttttcctttgataccacccatatcattaaataaacttaccgcacaatcttttcctatataaatatctaaaattgaaccactcatcatttcgtcttccttcccattttctgtcactgtaaacagctcagtatcctgcattgccagcatattccatgtatttaccatattgaaataattgactgctgccattgttgttgcgatatccataccttcatcacctcatagatatcagtgtagcattctttgtgcacacttgcaattactttctccctctttccctctccgacatcgggacttcatttttcatgtaagtatcccacacctgcatccgatcctgctcatccagtttgcgcaaaacttttgccggaacacctgccacaatacagttatccggaacatcgcgggttacgactgcccctgccgccacaatacagttctttccgatggtcactccgccacagatcgttgcactcgaacaaatccagcttccgcttccgatatggatgggctttgcatactccaggtcatgaaaaccatccggatactgctgcggcagccgctcatcggaaagaaacggatgacacggggttgcaatcgtcacgtttgcgcctacccacacaccatcctccagcgtaatcggcgcacagtccagaaatgtacatttatagttgacaaaacagccttttccaaaatggatattgacaccatattcacagtaaaatggggcaaaaatggctgctcctccatcctttgcagatggaatcagtttttctaacaaacgctgttttctttttttcctccacagcggagtgcggttgaatttatcacaggtttccatgccaaatttatgatattgttccagatctttgctatcggcattgtaaagtctgccggctttcattcgttcccagttattcatgtttatctccctcttttttatttcctttagtataacaaacttttgcaatataggaaactaaagaacagctgcacctgcatacttcccgtttaaagcatttgcagaacaaccagaccaaatttactgcgataccggacagttcctccgatgaatttggtgactatctggttctcttaggtgctattatgcgcgaggaaatgatgattgactggctaaaaaaatgtatcaaactgctcggttaacatgctccctctcccttcaaataggcgatcacttcgaatagatccggtaacaccacctctgctttttcctgcatttcttcatttgcaggcagcagatccggaaccatgatcggaagcaaatgtcctgcatgtgccgcacgaatcccattgtaggaatcctcaatcgcatacgcgcgctccggtgcaaccccaagttctgcacaggcctttaagaaaatgtccggtgccggtttgctgtgctccaccatatccccgcagatcacattgtcaaaaaaattcaaaatcccagcatcctttaactggtttgtcacggtctgtctgcgtgtcgaagatgccagcgcaattttctttccatcttcttttaaaaaggtgagcagttccacaacccccggcttcatcggaagcctgccgccatcgtatctgctgtgatagatagcagaggactctttcgcataaatatcatacggaaaatcctccccataaatttccagcataatctcccgcgtccgtttcatcgtcgtccccgtacaggaaagcaccgctttctcaatatctggaatctggtatttatctgcaagctccttccagcactgcatcacagcccgctcagaatcaaaaatcacaccgtccatatcaaatacaactgcatcgtaaccggttttcttttccatagaataatttcctttctgtcttacgtgacaattttattctaacacgatttatccaattagtgcatgatagattctcagatcatcgtccttgaatacgttaaatatgactttttttattctgctgtcctcattgatataattctttaccgtctcgctagcgatttctgccgccctttgctgtggaaaatgaaacacccccgttgacagacaacaaaaagctacggactctgctcccgtgtccgccgccagtttgagacattctctgtagcagcttgccagcaattcttcctcttttcctgtaacctcccactgtatgatcggtcctacggtatgaagaatatattttgccggaagattataaccggacgtaatctttgcctttccggtttcttcttcatgtccctgctttttcataatttcatacattttcaggcgaagttctatccctgcatatgtgtggataaaattgtcaatacaggcatgcatcggggaaaaacatccaagcatctgcgaattacaggcattgacaattgcatcgcattttaaggttgtgatatctccctgccagatataaagtcttggatcagatgctaccggtgtcaggtctgcaatgtctgtgatccctcgctccctgtttctttcgataagatattcgtcctgaatccttaagaaatctgccgggattggttttggcaatctggtattcatcagggaacggagcaaattctcctgtccctgtttatctttaggaatcttttgcttccgaaaacggatttcctctttcagaagatattgaatcaggcagcatcttctttcttcctgtgtcataatacactcccccttatcgcagtaattgcctttgccatatcaccgccgatcccaattgcgcgctctttaaagctttccggcactaccgcctcatctttattcaatcgaatcaggctgtatgacttattttcacgtaccattttttcaaacggaaaccggataataatgggtgtgttgaatccgactccaagttctaaaagtacaacctttttatctttgttctgttccagaaaatccgcatatctgtcggcagcctcatgccatgcctcatcttctacgaagtaactatcacagcgcagatgcattgccatttttcctccgcataccggacatttgggcacaagttcggatgggatcagacagtcttttctggcagcatccatcttttcaaacagttcttttgcatcatacacctttggatgacagccgcgctgacactgaatttctccataatcgccctgtgttgcaaaaatccggtctgccgaaaatcctgctttgtaaaactgatgatcgacattcgtggtaagtacaaaatactccttatcctgcaccatggcaaacaattcctgatacagcggcaatgccggtggatcaaaccggttgatcagcgcatgtttggaccagtagccccatcttgcttcctccgaaggaaatggataaaaacccgctgcatacatatcggtcatatactgaccaccatattttccgatgaattccgcaaagttttcccgaaaccgctttccaccatacgcaagtcctgccgccgtggaagctcccgcgcctgcacctataatcactacatcggcatcctttaggagttttgccgcatttgcgatctgttcttcgtatgcatctttttgaaatatataatcgtctgcgggtgccccacacagaaatttattccagtttacatgacttttgtgaatttttcgaaaaaacatacctaacctcttttctcaatacattgtttcggacaaatttctgcacatcttccacaatggagacaatgattctgatcgattacaaccggcttcccagacacgtcaatgcatttctgcggacaaacagaataacagagtttacagccaatacagttttgtcccacgaaataaccggtttggattttctctcctttccctatcaggatcgtatctcttacgctctttgacggattgctgatatcaaagtattccccctgcgcttcatacaactgaaatacttcgagtgcttcccacgtatcccccggatagatttctttcatgtagggatttttctcaaacatgagagtaagattcttctttccgatatttttcacgtttccgcgaagcgatactgcacgcttgtcttttgtcgccgatattgccacatactgctgctccataagctgttcgtaaaatgcttttccttttgcagtaagaaaatataccccatccgcatcgtagtacatcatatcaataattcttgtctgcggatgtccgtctgaaccgattgttgcaactgtggtggagtgaatttcttcaaccaaaaactttaaataatccatatgtgccatttcaaaacttctcctttattaaacagcaacccccgcgaaaagcgagggctggtgctacatgtcagggtttcataaaaattagaattcgtaaggtggatttcctgagaaatcagcgatcacaccgtgaggattttcaaggtaaaatacctcaaaaatcggattatctgctgtctgatactgtcccttaacgattggattgttcatgcagccttccttgacactcatgttgtcttcaaatacagccttgccatgaagacggatccatgcatactctggagaagaaacggatacttcgatttccggattcgcaagcatatctttgtaaacatcctttgtgttgtttgtgcagaaccagagctttccatcctgctcaaagcagaacatgaatggacggcactttgcctttccgtcacgtcctacagttgctaaatactgtactgggtttgcctgtaaaaattctactactttctgcataaaatagtacctcctgaattgttttgttgtaactcttgttgttacatctgatggttgtactataacatggttttaatgtaacgtcaatagttacatcagaatttttgtagcttttttggttacatctgattttttcctataaaataaaagccccagacttatcatctgaagcttcctttctactgctctttttctatacatgaggcaacatcttttttcacatccgcaagcgttatctgggaaagtttttcttccattgccttttgcacctccagcaatcggttatccaaaacacggtgaatatttttccctaccggacagttcggattcggattctcatgaaaatgaaacaattgttcctccggtgtacactctaccgctttgtatatatcgagaaaggtaatctgctccaaaggtctggtaatcgtaactccgccggttcctcttgacacctcaatcagccctgccgcctttaactgctgcaatatttttcgtattatgaccggattcgtaccaatgctgcccgccataaaatcgctggtcatcttctgatctgaaaatgtatctatacaggtaaacatatgaattgccatcgtaaatctgcttgaaatctgcatgatctgcacctcttttccgtgtttatcctatcagattgcgaatgtaattgcaatggttacgttactgttcactcagtgcctgaacaacaaagtattcaggtgttgcgtgaaccgtaaaaatcgtcatttgaattgaacttataaaatccctctacggctttacaacagaatctttgatctgcagttgctgtgaaatcgttccactttcatataagaaatcggcagttttctgcagatccgccacaatcgtattttctcctttgaataggtccgttccatctgctaaaatctgtgtgtccccactgctttgaattttggtgatggatggttcccaggtcgtgacagcatccacctgtccctgcgtcagtgccgttgcctgctccccattataggaaattccaatgatagaacggttctgtccggctgcaatccctgaaatcgaaggcacatttcccattactccgatgtcctgctgcccggccgcgaacgatttattttccggtggtccagattcaaactccgtaaagttgatgtctactgcatcctcttttaatgcatcggtaagccaccctttatcccgcaaaacgtaaaacgatacatagccgggaaccggctaaatggcaatattcagatgcgtcccggtttcggaagatgcctcctgtttgaaaccgcatccaaacatctgaagtgcaaaagctgtcacaagcagcaacacaataattttattgtgtcaggcaccttgttcctttatgatcctgttccacatttctctaccttcggaaagaattatacccgccggtttaaggataccgatctatttgagcagatttttcagcatatcctagaagaatgctaccgcttcaagttggttgatccaacagaaatctttgtcgatgcaacgcatgtcaaagcaagggctaataacaaaaagatgcaaagacgaattgcacagcaagaagccttattctatgccgatatgctacgcaaagatatcaatgctgacagagagaaacatggaaagaaaccgctaaagataaagatgatcataataagcccggagccaatggcaatgataaatttgaagactatacggatgacattccgctagacggaaaaactattaagtgcagtacaacagatcctgaaagcggatggttccgaaagggcgaacataagcatgtgtttgcctatgggattgaaactgcctgtgataaaaacggatggattatcgatttcacagtaaatccaggaaacgaacatgacagcagaacttttaaaggtctttatgataagcttacaaatgttagaatgaaatactgtattgttgacgctggttataaaactcctgcgatagcaaaaatgcttatagacgatggtgtgacaccagtattcccatacaaacgcccaatgactaaagatggatttttcagaaaacatgagtatgtgtatgatgaatacaatgatgcatacatttgtccgggtaatcatttcctgcactatagcaccaccaatcgagatgggtatcgggaatacaaaagctgcggaaaaatctgtgagggatgtcaatatctgtctcagtgtacagcaagcaaaaatcatgtaaaacttgttacaagacatgtttgggaagattacatggaaacatgctaagatattcgtcacacagcggggatgaaggatttgtattcacaccgaaaggaaactatcgaaagaatctttggaacagcaaaagaaaaccatggattccgatatacacaaatgtacggaaaagcgcggatgaaaatgaaagtcgcgctcacttttgcgtgcatgaatttaaagaagcttgcaaaatgtaagaaggaatggggattacaaatgtcataaatccggtggaaatatgcttgtttaaacaaaacaccttcgcaatggcgagaaaaaggctccgagaaacataatttctcggagtcctttgtctacagtctgaaaggaaggcgagttgattctcgccttcctcagactgtagacaaagtcctcggctttttgccgaggatttttctgtattaaagaggctaaaagtcagtattttcaagacttttcagtctgagtgggggaaaagcccgagatgatatcagaggcttacctatcactataaaactcggacttcgtgtatatgctcaaccaggcaggcggagaccgccagatccttgccaagcagctgggcatctccacgcaccagctgagctatgtgacccactccggtgagggcgagggcctgctgttttatggctctacaatcctgcctttcgtggatcacttcccgaagaataccgagctttaccgcattatgaccaccaaaccccaggaactgaaaaagaaggaggatgaatgatgatgaaccccaacattttgaataaaaacccgttgatgtttttcgacagggcggtaaatgcccagcgcagccagctgcttacggtcatggccgatgcggtcagcgagtgtcgcacggcggcagaccaggcagccgaactgaatgagaccggtcagatggggctgctccgtttggcagaggtctggagcaccatccgtgccaaggaaggtatgggtggtctggttctggaaggaaccgaagcgaagatcctgtccgatgtggtggcacagttttatgcctacctgtccggctgtatgttcaacgatcctgtgggaatggccatttatgcagagctgcactacatgatgtcctccctcatgctgggagaatggtttgaataaggaaccgcgcctgcgctttactgatgaggaacggtctgaccctgcactggaaaagccgatccgtaaagcggagaaagctgcggccagagcagataaggcgcaggccaatatcccaaagaaaaaggtcaggcagacggtcattgacccggataccggaaaaaagacctcgaagctgacctttgaggacaagaaaaagccaccttccaaagtttctcaaggagtcagggaagctcccgtccatctggtcgtgggcaagctccacaaagagatccgggaaacagagcaggacaatgtgggcgtggaaagcgcccacaagtccgaggaggcggtggagaccggcgcttatctggtgcgggagggctatcgcagccacaagctgaagccgtaccgcaaagcagcacaggcagagcgtcaactggaaaaggcaaatgtaaatgttctgtaccagaaatctttgcaggaaaatccccagtttgccagcaatccgctttcccgctggcagcaaaagcaggccatcaaaaggcagtatgccgccgccaaacacgccggtcagactgccggaaataccgcccaggctgcgtccaaaaccggaaaagtcgcaaggacggtaaaagaaaaggcacagcaggcaggggcattcgtcatgcgccacaagaagggtttcctgatggcaggggttttgttcctcattacctgtatgctgatgaataccatgtcctcctgctccatgatggcgcagagcatcggttccgttctctccggcaccacctatccgtcggatgacccggaaatgctggcagtggaggcagattatgcagccagagaagtccagttgcaggaggaaatcgacaacattgaaagcagccacccagggtatgacgagtatcgctatgaccttggtatgatcggccatgaccctcatgagctggcagcatttctgtctgccgtcttgcaaggttacacccagcagagcgctcaggcagagctggcgcgtgtgtttgcagcacagtatcagctgacgcttactgaggaagtggagattcgctaccgcacggagacctccaccgacccggagaccggcgagaccacctcagaagaagtcccctatgagtattacattttgaatgtgaaactcaccagcaagcccatttccgctgtggcgtcggagttactgaccccggagcagatggaaatgtatcaggtttaccggcagaccatgggcaataagccgctgttgtttggcggtggttcccctgacatgagcaattccgaggacttgaccggtgtgcagttcgtaaatggaacccgtcccggaaatccgcagctggtggagctggccaagcgtcaggtcggcaatgtgggcggctatccttattggagctggtatggctttgacagccgcgtggagtggtgcgcctgctttgtatcctggtgttataaccaggctggaaaaagtgaaccgcgctttgcaggctgtgagtggcagggcgttccgtggttccagtctcatggacaatggggtgcaagaggctataacaatctggctcccggagatgcaattttctttgattgggatttggatgggacagcagaccatgtgggtatcgtgatcggtacggatggcagccgtgtttatacggtggagggaaattccggcgatgcctgcaagatcaaaagttatgacctgaattatcaaagtattaagggctacggcctgatgaactggtaacagactttgtggaaaggagtgaacggttatggcaaaaaacaaaattgaacgtatcgaccaggaaattgagaaaacccgtgagaagattgcggaatatcaggaaaagctcaagaccttggaagcacagaaaacggaggcagagaatctggaaatcgttcagatggttcgtgcgttacgcatgactccagcacagctgaacgctatgctttccggtggaatgaaccacggcagagatacagcactgtcggaatcaaataatcaggaggctaccgcttatgaagaataaaagaatttgcaaaacactttccgccctttgcctgacaatggttgtggcatttggatttacgatccctgctttcgcacaggggtcagaacaggctccggcggcaccggcagaggattctaccaatgacagcaatgtgattgtggaagaagcagaaccggcaccggcacttacaccagatggcaatgccgctctggtggatgattttggtggcaataagcagctcattaccattaccaccaaggcgggcaactatttttacattttgatcgacagggctaatgaggataaaaagactgctgttcactttctgaaccaggtggatgaagcggatttgatggcactgatggaagatgaaaatgtcaaagaggagccggctgctgtgtgtagttgcacgacaaaatgtgaagcaggggcagtcaatacggcctgcccggtctgcgcaactgataagagtaaatgtacgggcaaagcaccggaacctccggcagaaacatcggagccggaaaaagagaagcctgccggattgaacccggcagcgctggtccttttgctggctctgcttggtggcggtggcgtatttgcctactcgaagctcgttaagaacaagtctaagaccaagggcaatgacagtctggacgattatgattatggcgaggaggattccgaggaatgggaaaccgaggatgaggagtcggacgagccggacgctgacgggggcagcacagaagaagatgatgaggacagtgtgaaatgacccgtttcacagacagtccctatgaacgcatgatgacacgcaggccggagggcgggaaggaaacttcccgtcctccttctttaccccacagccacccctgctatggttgcgggaattatggaagaccctgcgtaggtatctgtcaccgggaaatgtcccgatggctcaaagagaggaggaaccatcatggctcaacataaattggtaattgccgaaaaaccatcagttgcccagagcttggcggcggtgatcggcgcaaccgtccgtaaggacgggtatctggagggtaacggctggcgtgtcagctggtgcgtgggccacctggccggtcttgcggatgcagacagctatgacccaaagtatgccaagtggcgatatgatgatctgcctatcctgccggaacattggcagatggtagtgggaaaggataagaaaaagcagtttgatattctcaaaaagctgatgaatgccccggatgtgacggaagtggtaaatgcctgtgatgccggacgcgagggcgagatgatcttccgtagcgtctatgagctggcaggttgcaagaagccgatgaaaaggctctggatttcttcgatggaagactccgccataagggaaggctttgcaaacctgcgccccggtgcggactatgacggacttcgagatgctgccctctgccgtgccaaggccgactggctggtggggatcaatgcgacaaggcttttttccgtgctgtatcaccgaaccctcaacatcgggcgcgtgatgtccccgacgctggcgcttattgttcagcgagaagctgagatcgacacctttcagccggttcccttttataccgtggcgctggagctgcccggtcttaccgtatccggggagcgcatggcgaataaggccgctgccgagcagctgaaagaagcctgtcagggtgcaaatgtcacaatcaaaaatgtggagtgcaaggaaaagtctgaaaagccgcctgccctctatgacctgactactctgcaaagagatgccaaccgcctgcttggatttacagcccagcagaccctggactatctgcaaagtctgtatgaaaagaagctttgcacttatccccgtactgacagccgctatctgaccggtgatatggcagacagcctgccggtgctggtcaatctggttgccaacgctatgccgtttcgcaaagggatcgccattacctgtgatccgcagacggtcatcaacgataagaaagtaactgaccaccacgcagtaatccctaccagaaatctcaaggatgcagacctttctgctcttcctgcgggagaaaaagcggtgctggagctggtggccctgcgtctgatgtgcgccgtagcccagccccatatctattcggaaaccgttgtgattgcagcgtgtgccggtggggagtttaccacaaaaggaaaaacagtgaagcacccaggatggaaagtactggaagacgcttatcgtgccaaaatgaaggatacagagccgaaaaaagagggcgcagagaaagctctgccggagctgaccgaaggccagaccctttcggttgctgcggcaatcgtcaaagaaggcaaaagcaatccacctcagcactttacggaggataccttgttgtccgcgatggagactgccggaaaagagaatatgccggaggacgccgagcgaaaaggtctggggacaccagccacccgtgccggtattttggaaaagctggtatctgccggttttctggagcgaaaaaagaacagaaaaacggtgcagcttcttccttcccacgatgcagtatcccttatcacggtgctgccggaacaactgcaatcgccgcttctgactgccgagtgggagtatcgcctgggcgagatcgagcgcgggcagcttgccccagaggagtttctggacgggatcagcaccatgctgaaagatctggtggggacttatcaggtcatcaagggaactgagtacctgttcactccgccccgtgaggtggtgggcaaatgccctcgctgcggcggtgaagttgcagaactgcaaaaaggcttcttctgtcagaatgattcttgcagattcgcaatctggaaaaacaacaaatggtgggctgccaagaaaaaacagccgaccaaggctgtggtgtctgcgctgctgaacgatggccgtgtccgtgtgacggggctatattcggagaaaaccggcaagacctacgatgccactgtggttttggaggacgatggacagtatgccaacttcaagctggaatttgaccagcggaaaggaggcagccgatgaagctctctttagtggaacgggaaaccattctcctctataaccaggcagaaccaatggctgaggtctatacccacgatccccgtctgatggagaagctggaactgttggcaaaaaagcaccccgaccagatcacccgaaaggacgcccataactttaccgtccccaagcggtgtgtatcagtccgggagccatacagcgccgagcgccgcaaagctgccagtgagcgtgcgaaagccgccggataccagcccccagtgaaaaagtccggcagttaaaggcacatggcagagaatgtatttgaagcggtcaagcagtcggtcagcaccagagaagcggcagcgttttatgggatcgaggtcaaacgaaatggtatggcctgctgtccctttcacgatgataagaaccccagcatgaaggtagaccagcggttccactgctttggctgtggtgcagatggggatgtgatcgactttaccgcaaagctctttaacctctccccaaaagaagcggcagagaaactggcacaggactttggcctgatctatgacagtcaggcccctccccgcaggagatatgtccggcaaaaaaccgaggcacagaagtttcgggaggatcgacagcgctgttatcgcgtactgtccgattactactatctgctgaaaaaatgggaagccgaccgttctcccaggacaccggaggaagaaccgcacccccgttttgtggaagcaatccagaagaaagcctatgtagaatacctgctggaccttttcctttatgaaagtgaagaagaacaaaaggcatggattgcagaacacacagcagaaatcacacacttggaaaggagattgaaaatcatggctgagaacaaacccaccaaccgagaacggctaagggaaatcacagatggcatcgagcagggcatcaaagaactgtttgagagtgaaaagtatatgcgctatctgtccgtcatgtcccgctttcaccgctattcggtaaacaacaccatgctcatctatatgcagaagccggacgccacattggtagccggatacaataagtggaaagaccagtttgagcgtcatgtaaaaaagggcgagcatggcattaccatcatcgctcccacaccgtataagaagaaaatcgaggagcagaagctggacccggataccaaggctccgattctggatcaagacggaaagatcgtcacagaggaaaaagaaatcgagattcccatgttccgcccggtcaaggtctttgatgtgagccagaccgacgggaaacctttgccggagcttgcatcatccctttccggcaatgtgccaaattatgaggcattcatggaggccctgcgccgcagcgcaccggtgccgattacttttgaagcaatggccgccgatacggacggctatttttctgccgatcatcagaaaattgccattcgtcagggcatgagcgaggtgcagacggtttcggccacggttcacgagattgctcacagcaagctccacaatcagaaaaagatccagattgccaatgacgagcaatatcaggagatcgagctgtttgataaacttggtctgttttccaacggacggattgctcgcgataatctgccagagggcgtttattgctatgacctgcgcggttctgactacgatcctggagatccggtctgtgtggaagaacgagtggttgtaaaccatgcaggctccgttctgctgacagagccgttggaactgacggaagatggacgcttgatgctgaccgaggaaaaagggctgaattttaccggtggcttttctaccctctcccagtttttgcagaaacagaggaaagatcgtcacacggaggaagtagaggctgaaagcatctcctatgcagtctgcaaatattttggaattgagacaggagaaaacagctttggctatattgccagttggagtcaaggcaaggagctgaaagaactgagagccagtttggagaccatcaacaaaacctccggcactttgatctccgatattgagcgccactataaggaaatctgcaaagagcgcggaatcgaccctcatgcaaaggtagagccggaacccgccccgatagagcagccagaagatgccgctaaggtatctgatagacagcagaccggcgatctgacctactatgtagcagagtgcatggaatttccaaacctcggagaataccacgataacctgtctttggaggaagcaatccgcatttatcaggagattccggcagaacgaatgaacgggatcaagggcattggttttgagctgaaagacggaagcgactatgaaggaccttttccgattttgaccggccagaccattgacctggacaccatccaggcaatcgactattaccgtgataatcctctggtgcaaaaagcggtaaaggaactggctgcggcaatgccggaaatggaagtgctgggggcggacgccaatcagcaggaggctttgtttctgatcgacaatgccacctatcttcatatccagtcctgtgacagcggctgggactataccctttacgatgccgcatccatgaaagagctggatggtggtcagctggatatgccggagatttcccgcatgaaggcagttctccagatttgtgatgacaacgatttgggcagagactcggtaaaatacgcaccgttgtccatgattgagaccttgcaggaagctgcctaccagcagatgcaggcaggggtcagtcagatggctgcttcttcccagctgccggaagcacaggagcaggcactggatgaataccccgtgccggatgagcaggtctccacaccggatatgcaggaatacggctacttctatgatgggatgctccctgtcaccagagaacgggcgctggaactggatgccgccggtttgaccgtctatgtgctgcatgaggacaatacggagagcatggtgtttgacccgcaggaaatcatggatcatggcggtctttttggcgtggaccgtgaggaatgggagaaaagccctcagttccacgaaaaggtcatggagcgtcaggaacatcagcaggaacgcgaacaggcatttctatcccagaacagagattgctttgccatctatcaggtgagccgtgacgatccgcagaatgtgcgctttatgaatctggattggttaaagtcccatgacatttccatagaccgcagcaattatgacctcatttacacagctccgctgagggagtctggcacggtaccggagcagctggaaaaactatatgagcagtttaatctgcaaaagccggcggattttcacagtccttctatgagtgtcagtgacatcgttgcgatcaagcaggacggtaaggtatcctgtcattactgtgacagtgttggttttacccagatccccggattcctgccggaaaatccgttgaaaaatgcggagatggccgtggaggacgattacggcatgatcgacggtatcatcaacaatggcgcaaaagagcctacggtggcagagctggaacagcaggcccgaagcggtcagcccatttccctcatggatttggctgccgctgcccatcgggaggaacgggaaaagaaaaagtccgtcatggagcagctgaaaagccagcccaaggcagaacacaaaaagatagcgccaaaaaagagtgcggaaagggagatttgatatgggaaactttacttttgaggaaatgaacctgatgtgcatttacaataccggcagccgcaccggactgatcgacagcctgcgtgagatgcgcggcgagctggccccggaggaaaccgagctgcgggagttgacagacagcgcactgggcaagctccaggccatgagtgatgccgagtttgccgagctggagttgtatccggattttgaccagtaaacactataatcgcagggatggggtggcaatatgccaccccacctttttaccccaaaactgaaaggaggacagaacactatgccaaccaaagctgaactatatgcacagatggcggagaaggtaacaacgcagctcacggggagctggcaggaatgggcagggtttctcaccactgcttcccgcctttacaagtacccgttccatgagcagttgatgatctacgcccagcgtccggacgccaccgcctgtgcagagtacgatttgtggaatgaaaagatgggccggtatgtaaggcgcggctccaagggaattgctctggtggacgattccggggacaggccccgcctgcgctatgtttttgatatttccgacaccggaacccgtgaacattcccgtactccctggctgtggcagctggaggagcgccatttggattcggtgcaggctatgtttgagcgcacctatgatgtttccggtgatgaccttgccggacagctcaccgaggtagccggaaaactggctgaggaatactggacggagcatcagcaggacttcttctatatcgttgacggttcctttttggaggaatatgatgagtttaacatcggagtacagttcaaggcagcagccaccgtcagtatcacttacgctttgatgtcccgctgtggactggagccggaacgctacttcgaccacgaagatttcatggcgatctttgatttcaatactccggcaaccatcggagcgctgggaacagcggtcagccagatcaaccagcaggtgctgcggcagatcggcgttaccgtccgaaatgcagagcgcgaagccaaccaagaaaggagcaaacaagatgaacaatcccatgacctatatccagaacggagactatctgattcccgacctgaagctgagccagcagccggagaaacccctgggcaagtacggcaggatgaggaaaacctacctgaaggaacatcgtcccatcctctacaaccagatgctgctgagcgagaagctgtaccagcaccttctggagatcgacgagaccgcccagaacagactggagcagatgatgccccagctggcgaaggaagcgggagccaccgaggaactgaaagccagcgatcccatgaagtgggtggggctgatgaacaactgcaaagcccaggcagaggagatcctgatggcggagcttatcaacagctgaccctaaacctgttcctctccgaagcggaacagatccaatccatagatgaagcagagaatgtagcgcatacatcctctgctttttcttttgctcaaaatgatattgaccatgtgctgcgtttgggcggcaatacagaccgccagagggagcgtgtggttgcagcctttgaaaagcagaaaaccaccgctgagattgccgagatactgaaaacgctgtaccacggcggcaacggccttggcagtgtgagcgcatggtatgccgaggatggtatccatctttctcatgggaagtctgtccgttatgacaggtctgcccaggtcatttcctgggagagcgccgcagagcgtatcggggagcttttggagagcggccagtttgcctccaatgtggaacttgcagaagcggcaggctatgaacgctccctccttgccacaaagttctggaacctatatcacgatctcagtgaggacgccagagaagccggatatttgtcctgcctgtcagagatcaagggcaatgggttcccggaggagacccaccgcctgacggagcagctgaatgacccggccttccgtcagaccctcaaggaagaatacgccgccttctggactgcctatcagcaggaccgtgacctgttgcgctttcactaccataggccaagggaaatctgggagaacctgaaagaccttgacctgccccgcaggactttttcttcggacctttttcaagtgccaaccgtccagcacttcattaccgaggatgagatcgacgccgccatgaccggcggcagcggtttcgccggaggaaaaggccgtatctatgcgttcttcatggaaaaccacacggacaaggaaaaagtgagattcctcaaagacgagtatggcattggcggacgctctcatgccctgtccggcgcagcacacagcggcgaagatcacgacggaaaaggagtgcactataaaaagcaggactgcccggatgttcacttgaactgggaaaaggttgccaagcgcattacctcacttgtccagaaaggccgctatcttaccgaacaggaacaggcgcagtatgacaaaatccaggctgaaaaggaattggcagaagaagatgccatccaagcccagcagccggaggtggaggaagaaacgccaaagcctacccttcgggagcagtttgagcagtataagactgtggtgactgccgccatttccgaggatgccgcataccgcaatgcctgcgggcattctgaccgtgaaaatgctgtcatcgagggtaatgccgctgtgcgccgtgcagtccttggttctaaggatatggagctgatccgactctattcggatgtgccggagttccgtcagcgtttacaccgggaagtgatcgacgagacctatccaaagctccatgagcttctgcgccctctttctcaggaagatattgatactgccctttgtgcatggaacggcaatatcgagagtaaacacgctgttgtccgctatatgaaagaccatgcaagagaaaaagataccgccgcatggctggctcaggaatacggcggcagtaacagcaacagcctgttcgttgtccgtgccggcagcccggaggaaacgcagctgccctggccgaaggtacagcgccggattgcccagctcattcaggaggaccggttctataccgaagaagaacaggaccgttttgacgacatcgacccaatcgccatccgggaagctctggaggaaagagggatcgtcaacggccaggtggcatacccggaaaaactggacaatgacccatttatccaacaggtggtgtcggatgtagagcagatcgcagctgccgagacagagcagccttccgaagtttccatttccgatgaggaatatgatgcagttcgcagtccaattccgcaaaagacttcttacgaccccgccgccccggtttatgccgtgggcgataccgtgtatatcgaggattccgcttatcagatcaccgagctgcgggatgataccgtgcagcttctgcccaccgggatggtatatcccatctaccgggcagagcgcaaagaacagtttgagcagctgcttcgggcagaccgccgcaatgcttactataccgagtttcttcctattgacccggacaaggcagatcaggacttgcgggatgtattggctcatggactgatgaatgaagcggataaaaagcagatttccacgctgctgcaatccggcaggagcaacagcgagatcgcctactggctgagcagagcctattccggtgagattgagacactgaatctggagaccggcgatattgccgattaccgtaccacggcacagggcatagaactggaagtcatggatgcagaggaaaagcgtctggctatgctgtatttccgctgggatgaggttgcgtctttgctgcgcgggatgtatgcccgtcagcaggacggttttggacaggaacagccccaaccggctaccgaatccccgaccttccattccgagaccatggccgtctatccgggcgataagaacaatctgccttatgatgtggtggtggaacgactgcatatcgaggagccggagccaccagcccctgtgactgagccggagaaaacctttgaggaagtgctggacgaacacccggtttccattcaggtcaatggccagtggcagaccttccccaatgccaaagctgccgaggaagcatcttatgaggaatacaaggctaacctgcgccgcaatgcaaaaaacttccgcattaccgatgagcatttgggcgaaggcggtccgaaagccaagttccaggcaaatgtcaatgcgattcgtttgctgaaagagctggaagctgccggacagcaggcaagccccgaacagcaggaggttctttctcgatatgtgggctggggcggtctctctgatgcgtttgacccggagaaaccggcatggactttagagtatgcccagctaaaagaactgctggccccggaggaatatgccgccgccagaagctctaccctcaacgcccattacaccagccctacggtcattcaggccatctatgaagcggtgaaccgtatgggatttgagaccggaaatattctggagccgtctatgggtgtgggcaatttctttggtatgctgccggagaaaatgcgaaacagccgtctgtacggcgtggagctggattccatcagtggacggattgcaaagcagctctaccccaaggccgacatcaccgtggccgggtttgagaccaccgacaggcgagatttctatgaccttgccattggtaatgtgcctttcggccagtatcaggttcgagataaagcctatgacaagctgaatttcagcatccacaactacttttttgccaaagcactcgaccaggtgcgtcccggcggcgtggtggcctttgtcaccagccgctatacgatggacgccaaggattccaccgtgcgccggtatcttgctcaacgtgccgagctgctgggagccatccgtctgcccaatgacgctttcaagaaaaacgctggtgcagaggtcgtttcggacatcattttcctgcaaaagcgggaccgcccgctggacattgtgccggaatggactcaaaccggacagacggaggacggatttgccatcaaccggtattttatcgaccacccggaaatggtgctgggcagacaggagccggtaagcactgctcatggtatggactacaccgtgaaccctatcgagggactggagctttccgatcagctgcatgatgctgtgaagtacattcatggcacttatcaggaggcagagctgccggagctgggcgaaggcgaagctattgacacctccattcctgccgaccccaatgtgaagaactattcctatgccattgtagacgggcaggtgtactaccgggaaaacagccgtatggtgcgccctgacctcaacgccaccgccgaagcccgtgtaaaaggtcttgtggaactgcgtgattgtgtgcaggaactgatcgaccttcagatggatgcagcggttccggacagcaccattcgggagaagcaggcggaactgaacagcctctatggcagcttttcttccaaatacggtctcatcaatgaccgtgcaaaccgtctggcctatgcagacgattcttcctattacctgctctgtgcgctggaagtcatcgacgagaacggaaagctggaacgcaaggcagatatgttcaccaagcggaccatcaagccccatcaggcggtggctgtggtggatacggcaagtgaagcactggcggtgtccatctcggaaaaagcctgtgtggatatgggctatatgagccagcttaccggaaaaacaaaagaagaactggccggagagctgcaaggcgtgatcttccgtgtaccgggacaactggagcaggatggcactccccattatgtgactgccgatgaatacctttccggcaatgtacgccgtaaactgcgtcaggcgcagcgtgcggcacagcaggacccttcctttgcagtcaatgtggaagcccttactgccgcccagcctaaagacctggatgcgtcggagatcgaggtgcgcctgggtgcaacctggatcgacaaagagtacatccaacagtttatgtacgagaccttcaacaccccgttttacctccagcgcagcatcgaggtcaactattcctcctttaccgctgaatggcagatcaaaggaaaatcttccgtatcctacaacgatgtggcagcctacaccacctacgggaccagccgcgccaatgcttataagattttggaggacagcctgaacctgcgagatgtccgtatctatgacaccatagaggacgcagacggaaaagagcgccgtgtgctgaacgccaaggagactaccctggccgctcaaaaacagcaggcgatccgggaagcctttaaggactggatctggagagacccggaacgccgtcagactttggtgcgccagtacaacgaagaaatgaactctacccgtccccgtgagtatgatggcagccatatcacttttggcggcatgaacccggccattaccctgcgggaacaccagaaaagcgccatcgcccatgtgctgtatggcggtaatacgctgctggcacacgaagtaggcgcgggcaaaacctttgagatggtggccgctgctatggaagccaaacgcctgggtttgtgccagaaatctctttttgtggttccaaaccacctgaccgagcagtgggcgtcggagtttctgcgcctctatccttccgccaacatcttagtcacaaccaaaaaggactttgagacccataaccgcaaaaagttctgcgcccgtattgcgaccggtgactacgacgccatcatcatgggacacagccagtttgagcgtatccccatcagccgggagcgtcaggaacggcttctctatgagcagatcgacgagatcaccgagggcatcgcagaggtgcagaccagcggcggcgagcgttttaccgtcaagcagctggagcgtacccgtaagtctctggaagcaagactggaaaagctgcaagccgaggggcgaaaagacgatgtggtaacttttgagcagctgggagtggaccgattgttcgtggacgaggcccacaactataaaaacctgtttctatatacaaaaatgcgaaatgtggctggtctttccacatcggacgcgcagaaatcctccgatatgtttgccaagtgccgctatatggatgagatcaccggaaaccgtggcgtgatttttgccaccggcacaccggtcagcaactccatgaccgagctttacaccatgcagcgttaccttcagtatgaacgcctgcaagaactgaacatgacccacttcgactgctgggcttcccgatttggggagactgtcacagcattggagctggcaccggaaggaaccggctaccgggcaagaacgagattcagcaagttctttaacctgccggagctgatgaacctgttcaaagaagtggccgacattaagactgccgaccagctgaatctgcctaccccggaagtggaataccacaacatcgtggcgcagcctaccgaacatcagcaggaaatggtcaaggccctttcggagcgcgcatcgctggtacacagcggaaccgttgacccgtcccaggataatatgcttaagattacctcggatggccgcaagctggggctggaccagaggatcgtcaaccagatgctgccggacgaacccggaacaaaggtcaatcagtgtgtggacaatatcatgcagatctggcgggacggcgaagctgacaagctgacccagctggtgttctgcgacatttctacaccacaggcaaaagctcctgcaagcaaggcggcgaaaacgctggataatccactgcttcacgcactggaaggcgctgtgcctctgccggagcaggaaccggcctttacggtatatgacgatattcgtcagaaactcattgctcaggggatgcctgctgaccagatcgcttttatccatgaagccaacaccgaagtcaggaagaaggagctgttctccaaagtccgtaccggtcaggtgcgtgtgcttatgggaagtaccgccaagatgggcgcaggcaccaatgtgcaggaccgccttgtggcgctgcatgacctggactgcccgtggagaccgggagaccttgcccagcgcaagggccgtatcgagcgccagggcaaccagaatccccttgttcatgtgtaccgctatgtgaccgaaggaacctttgacgcatacctctggcagacggtggagaataaacaaaaattcatcagccagatcatgacttctaaatcgccggtgcgctcctgcgatgatgtggatgaaaccgccctcagttttgccgagatcaaggctctgtgcgccggagacccccgtatcaaagagcgtatggatttggatgtggaggtatcccgcctgaagctgatgaaagccgaccaccagagcaagcagtaccgcttggaggatcagctgctgaagtattttccggaggagattgaaaagcacaagggctttatcaagggctttgaatctgacctggaggttttggcagctcacccacacccggaggacggctttgccggtatggagatccggggcgacctgctgaccgataaagagaacgccggtgcagcccttttggacgcctgcaaggaggtcaaaacctccgatccggtacagatcggcagctaccggggctatgccatgtccgtggagttttccgcctggaaacaggaatatacgctcctgctgaaaggacagatgacccaccgggcaacccttggtacagacccgcgcggaaaccttacccgtatcgacaatgccctcgcccagatgccgcagcgtctggaggcggcaaaggcccagctggataacctctatcagcagcaggctgccgcaaaagaggaagtcggaaagccattcctttatgaagaagaactgaaaagcaaaaacgcccgtctggtggagctggataccctgctcaacatcgacggaaagggacaggcacacgctgaggctgttgttgccaaaagcgcacggccttcggtgctggatcatctgaaacgcccggtgccgccacgcagtacagacaagaaaccaaaacagcatgaggaggtgcgataacatgaataccaacgatctgaatacagctctttatgaaaagatggctgctgagcaggacaaatacagggactggctgaaaagccagcccccggaagaaatcctgaatcacacctatgagtacacggttcgtgaggacattgtgatggcgatggaggaactggagctgaccgacgcccaggccaaggcgcttttggaatctccctcgccgctggcggatgtgtaccgctattttgaaaagctggagaccggctatatggatgtaataagggatagcattgagaaccgtgccgatgatatatgcagagccaaagaggaactgcgaacaacaccggtatatccctactctgccgcctatgcgagagaacatggggagctggagcagtaccgagcttccaacaatgcaaatctccaatgcaaggagtccattgaagcggcggtgcgggaacacttcgacggaatgtatctcagtcacgatgcggcaaagggtgtgatcgagacctatggcatggagcgtgtggctatggttctggctaacactgtccagcttcagaactgggatgggcgctactcccgacgcaacaaagaatgggctaagaccattcccaacgagaaccccgaaaccgtccgttgtggttatgtcctgaacagccaccctgctgtgctggatggctttattgatctggtgcgtgaagaacagcagcgcagccgtactcagggagaagaaacgcaaccgtcccgtccctcagtacgggataagctcaaacaggagctgcctgtccataagcctgccgccccgaagaaacgagagccggagcgataactatgacaaagcgtaagcgggatgttccggttttgttttgggtgtccgcagaagaattggaattgatccgtcaaaagatgcagcaatatgggacagaaaacctgagtgcctatctgcggaagatggctgtggatggctatgtggtgcagctggatttaccggagctgaaagaactggtttcccttatgcgatattccagcaacaacttgaaccagctaacccgcaaagtgcatgagaccgggcgggtttatgatgccgatctggaggatatatcccagcggcaggagcagttatgggagggcgtgaaggaaatccttacacagctttctaaactttcataacagggatagatactccatttgcggagggaggaacggcgtttcttcgccgcaccttcctccgctttttctttttgccggtatccttgtcttttgcctgtccataccggataatatgaaatagaatagaagcaaaggagtgaaaacagatgctgacatttgaaaaagtgttggagatttttgcagactatctggccgcagataagaccatcgaagtttatatcagccgtcatggatgtgtaagggttgagtttgaccaggactttcactattgcaccggcgaagtgtgccatactcccagggaactgtttgacctcttatccgatgattaccggacttatctggagattgaactgaccaaaggcagacgggaactgacggaagatgatataaaagaagcggataccctgtgcaaacggtatctggaccgctggaaggaggaattgggatgaagattttgaaatgcctgctgatgatcgtaactgcaccggtcattttggtgctgacgctttttgtctggctctgcacggggctgatctacatatccggtctggtgcttggcctgctcagcactgtaattgctctacttggcgtggctgtgctgcttacctattctccgcagaacggtgtgatccttttagtcatggcatttttgattagccctatgggactgccgctggctgcgatttggttactgggcaaggtgcagagtttgaaatttgcgattcaggatagggtttatggataaaaaatacgcaaagccacaaaatgccaaacaccgtctgttaaatttgggaagaggaactatatatccacgactttacttttgaactaatatcgcgtataatattagtgcgaaaggaagtgatatgatgggacaatttgaacagctggatcagatgttaacagcacaagaaggaatgctacgaacatcacaggtcgtatcttctggaatttcaaagccggtattttatgattatgtgcgttcacgagatttggatagagtcgcacatgggatttatctggccaaagattcctgggtggatgccatgtatctgcttcatttgcgatttgaacaagcagtattttcacatgaaacagctttattttttcacgatctgacagaccgtgaaccaatagaatatacagttacggtcaaaactggatgcaatccaagcaaaatgaaagcagaaggcattcaagtttttacgattaaagcaggcttacatgatgtaggacttacaacagcgaaaactccgttcgggcatactgtgccggtttatgatatggagcggacgatctgtgatttgctcagaagccgcagcagaattgaaattcagacctttcagggagcgctaaaatcttatgcccgtagaaaagataagaacctgcgagctttaatgcaatatgctgggatgttcaaggtggaaaaaattttacgacagtatttggaggtacttttatgataaaaacagcaaggcagcttaaagatttaatacgaaacctttccagagaaaaatccgcagatgctcagattttaatgaggaactacatgatggagcgttttttggagcgtatttctctttctgaatatcgtgataagtttatcttgaagggtggtatgttggtagcagctatggttggattggatgctcgttctacgatggatttagatgcaacaataaaaggagccaatgtcaatgtggaggatattgagaatctaatttcatcaatcgtaactgttccgattgatgatggtgttaaattccagctaaaaagtatttcggagattatggatgaagcagagtatccaggtattcgagtcagcatgagtacaacattcgatggggtagtgacccctttgaaaattgatatttctacgggagatgcaattactccaagagaggttcggtattcattcaaacttatgttggaagatcgctccattgatatttgggcttataatttagaaactgtgctggcagaaaaactggaaaccattattaccagggccacaaccaatacccgtatgagagatttctacgatatttacattttagaacagctgcatggaactacgctgaacccgaaaattttacatgatgcgcttctggcaactgctcataaacggggatcggagaagtatcttaaccaggctgaagaagtttttgacgaagtggaaaatgatttagttatgcaaaaactttgggaggcatactgtaaaaagttttcttatgcttctgatttggaatgggatgtgattatgaaagcaattcacaggttatatgttctttgcgagaagggcatcagcgtatgaaaaagcatggacactattgtaaaatttgtggcgaatacaaagccaacgaaaaattttcaggcaaaggtcatgcagcccacatttgtaaatcctgtgcttcgctaccagcagaaaagcaggctgaactgatgacactgaatcgtctattgaatcttccatgggggctatcgaaagagcagttatcctggctgaaaaatcgattaaaggataggaggcctgatgtccgtgcattagcacaagagcaatatgaaatgagatttccaccaaaacatttagaagatgataagttcaaatttttcgatgaagaaagttttatagaatagtgaaagcggtctgctacggcaggccgttttcttttcggaaaggaggttccttctatggcaaccacaagaatcatgccgcttcatgtcggcaagggccgcacagaaagtcgggcgatcagtgacatcatcgactatgtggccaatccccaaaaaacagataacggcaggctcattaccggctatgcgtgtgacagcaggactgcggatgcagagttccttctggcaaagcggcagtacattgccgctaccggacgagtgcgcggtgcggatgatgtgattgcctatcatgtgcgccagtccttccgccccggtgagatcacaccggaggaagctaaccggctgggtgtggaatttgccaagcgttttaccaaaggcaatcatgcctttgtggtctgcactcacatagacaagtcgcacattcataatcacattatctggtcatcggtcagcttagaatatgaccgaaagttccgaaacttttggagcagcaccaaggcagtccgacagttaagtgacaccatctgcgtcgaaaacggactgtccattgtagagaatccgaaacctcacggaaagagctataacaaatggctgggcgatcaggcaaagccctctcaccgagagctgctgcgtgtgacgattgacaacgcattatcacaaagtcctactgactttgaggcgttgctgaagctgctgcaagagtccagctgtgaggtatcaaaacgaggaaaatcgtatcgtctgaagctctccggttgggaaaaagccgcccgtatggacagcctgggcgaaggatatggattggaagatttgcaggcggttctctccgggaagaaagcgcataccccacgaaagaaagtggtcgcacaggcagagccgccgaaggtcaatctgctggtggatattcaggcaaaattgcaggcaggaaaaggtgctggctatgctcgatgggctaaggttttcaatctgaaacaaatggcacagaccatgaattacctgtcagagaataacctgttggagtatgcgattttagaagaaaaggctgcggctgccacggcacatcacaatgagctttcggcgcagatcaaagcggctgaaaagcgcatggcagagattgctgttctgcgtactcacatcgtaaattatgccaagacccgtgaggtctatgtggcataccgcaaggccggctactctaagaaattccgggaagaacatgaggaagaaattctgctccaccaggctgctaagaatgcctttgacgagatgggcatcaagaagctgcccaaggtcaaagagttgcagacagagtatgcgaaattgctggaagaaaagaaaaagacctatgccgagtaccggcgttcccgtgaggaaatgcgggagcttttaacggcaaaggccaatgtggatcgggtgctgaaaatggaggtagaacaggatgttgaaaaagaaaaagaccacggccagcgataagctggtcctggtcaaaagcgttcgcagaacgcgcagccacagaatgaaattctgtgttcaaaggggcttgggggcgctgccctcaacaagcaagcggagaggaaaatcacggagggattttgcgctctgcgggtcggtgtgtattaacaccggcattgcttgcccctttttacccggaaatgaaaggagccagtgaggaaacagtcaaatttcactcaccggctcaattcgtttcaaatttctcggatagttctgttagttctttcgcggtctcctgcgtatggcgcaagagggtttcacgcatttctgacggacagttgcaataaagtatcttcatctgagtggctccctcatcttctggagaaacatctggattgatcagagtgtccagagagatcggcagaacctttgccaacgccttcaaaatcaaataagatggatttatttttcctttttctatttttgcaatttgcttgatagatacatggctcagatccgcaagttcttgttgtgtcaggtcttttttctttcgggcttcccgcattttttgccccaaagcggtcaaatcatcaatcggcataatcgttcacctcaaatatattctatcgtgccgatttgcacaaaggaataaccttattatacctgttgacagatacgattatactgattttgtgagagggaatagaaaaagtgcagttgtatccttgatgagctatgttacaatgttgatagtaaggaaaaataaaaaatgttttgatttttagatttaggacatttctgtaacattttgtgtttatcctatcaatatagttgaaaaataaggaaggaagtgaatgtcttgaagaagattctaattgtagaggacgatcagcttttgaatcggacattggcatacaatctgacctctgatggatatgaggtcatttctgtttttaattttgacagcgcggtaagaaagctgcgcgaaaatgaatttgatgtggcactgttggatattaacctccccgatggcagcggactggatctgtgtgaagaaatccggaatcgcggtcagcatacctatatcatctttatcacagccaatgataaggagagcgatatgctcaagggatatgaagtcggcggcgcggattatgtgactaagcccttttctgtgacagtgctttgtaaaaaagtggcggcggtttttgcaaatctggagctgcggacaccccggcatgatctgtttgatgatggctttctgaaaatcgacttctccgaacaaagtgcgtcccttgccggagaatccctggactttacaccgaaggaataccgcaccctgttcctgttcgtaaagaacccccggattattctgaccaagcggcagattttagagaagctgtgggacattgatggggactttgtggatgagcatacgctgacgacgatcatcagccgtatccgtaaaaaaatcgaaacagacgagcggaaatatattaagacagcttacggcatgggctatcagtggatcggcggtgagcctcgatgaaactgcaaaatttatccgttagggcatttttgagaaaaattgtggcggggactctgctcactgccgctttgctgctgttgatttttttcctgttgacgaaagatgtgcgtgttgtcatctgcggcattattttgacagctgcattttacatttggggcatggtttttctgcactattttcaaaagaaactttctctgttcaccgatggtttgtgccagaccttggatcacatgatggacagtacagaccggccccaggtagactatgaagcggaaacactgctgtctcggatcagccaccgtctggaacgactctataatgtgatgcagaaaaccagacacatggcagagggagaaaaggaagaactgcaatccctggtatcagatatttcccaccagaccaaaacccccatcgcaaatttgaagctgatcaacgatacgatgctgacaaggccattgacagaagaaaagcgcaaggagtttttgcaggccacaggcacacagctggataaactggattttctcattcagggaatggtgaaaacttcccgtctggaaacgggtgtcattacgctggagaaacaagatgctgtgatcggggatacgctggtgagcgccatcaatggtgttttggctccgatggaacaaaaagagatcagcctgtcggtggactgcccatctgatttgacaatatcccatgacagccgctggacttccgaagcattgtttaacattctggataatgcggtaaagtacacctctgccggtggcagcatccaggtgagggtacgggattgggaaatgtatttgaggatagatgtgacggatacaggcagaggcatcccggaacattctcagggcacgatcttcaaacgcttctatcgggatgaagcggtgcatgatatagatggggtcggaatcggcttataccttgcccgtgagatcattaccatgcagggcggctatattaccgtcgagtctaaagttggggaaggatcaactttttccgtgttcctgcccataaaataattctgaggcagtctgttttggcaggctgccttttttgaaaaatttttagaggacaatggattttaggacaattctgcaacatttgggatttatgctgacagcaacatcatgaaattggaggtggccttatggaaatcacaaagacattactcatcaatgcagcttgcttgctgatcccgccggtcgttgttgttctgctgctccggcacttctttccaagaaaaatcagatggtcggctggtgtggtggctctggtagatctggtgatcttctggacagatatttcttattatgagagcgtttggctgacgctgttttttgttgtaattcagttagcaatggttttgcttatatctatccggctttataaaaaagacacacgaaaatgaattgtcctaaaattgaagcaattcaccctaaaactgttgagcctttgggatatttctgcaacatttgggggttaggatgacagcgaaaggagtgaatggctatgacattaccatttgaaaatgatacccgcatcattataaataaattagcaaaacgcaatgtatcttcaaatcgtattttttgcttttttaatgttttgaccattgcgctggcaattagtttgattgtgggaatctccttattccaacaaggaagcaaaattagtgaacaaaagattttgaatcaaatgcagcaagttaccatcggggggcttacagcagaacagatagaagttctgaaaaaagaacctgatcttgaagatattgtaccctataagcatagtgatagttttctgatggatgggatcaaatttgaagcggtttatatgccgactggttttggaattataaaatcctatgaattagtcagtggaacctgtccagaacagtacaatgaaattgtaattgataaaaatgttcaattagagctggggtatcagctaaatataggagataccatcactttaccaacggcggggagtaaaacagaggatttcatcattactggttttactgataatgtggaaacaggaacattttacttttatgtctccccagcgtatgcagaacagggtgtgttattatctgatattccatatagtgccttgattcgtgtaaatggtgccacggaaatgggacttattgattttgagaatacagtatatcgtctggctttatcccaagacataagcaggaaccaactttattttaatagcaaattctgttcctcacttatcagtggatcaggaatgggaggtgttcttttagctactctttttattgcattttcaagcggaattgtcatatacagtgtgttctacctttcggtatcaaatcaagtgtcgcagattggacagctcaaaactattggcatgacagaaaaacaaattaagcggatgattcgtaaagaggggtatcgtttctgcctgttcggaatacctgccggtattacagtaggtatcatatttgcatatttgctagagccgaatggaataacgattatcaatgccatagccacaagtattttagcaataatattaggcattatcatcgtacaaatttccgtatacaagcccgcacaaatagcttcaaatatttcccctattgaagcaacaaaatatgttggaaacgatccagaactaaaagaaaatagagtgcagaataggaaaaatcatattcggctctcaccgtattctttagccgtattgagcgaaaagcagaatcgaaaaaaacacaatctgacgattgcctcgcttgcaatcggcgggattttatttatggttggagccacttttatatcatcatggaatccagattcctttgcaagaatggggaatttggaagatggagaatattatattacgattaaccacaatacattagtcaatcccaaaccgtatggtatttcggagtatcaagttaatacgcctttttcacaagaactcatggaagaattgcaacaaatcccggaagttaaagagatttatgctacggagagaaccgcagccattattgagtatcacgatgaacaattagaaattcccattattccgattacacctgataatcaggaggaaattttgaaaacgcttcctgttgattggacatacgaaacattggtgaaacaagacgctatggttatattaggaacaagcgtacagaaagaagtctatcatgcttgcccgtcaataggagaaaaagtgacattacgatggtttgatggaactgaacacagcatagatgttttgattgccggtacttccgaaaaaagtatgaatgagggcttttatcttccaaaagaaaccatagaaaagttgtggggcgatatggatttaacagcttccttaactttgtccgtacctgaatatgaaaaagtgggtaaatcagtagaaagcaaattaaataaaatactgtcccgacaccctgatttggtaatggaaaccttacaagaggtaaaagcatcttcggcaaatacgattcataataccagcgtacaagtttatggggtatctgcctttgtcattatgtttagcatttttaatctgacaaacaccttgattagtcgtatcagtacaaggagaaaagaatttggaatattggagtctatcggtatgacaaaaaaacagataaagaaaatgctgctgcatgaaagtgtcttactgattattccatgcttgattattacggttgtggcaggaaccttgatgggttatttgttagtacggatattgtctgcgaatggattaacttattttcaatatgcttttccttttattccattactgatttacggtgtctgcttaataataacacctattataatttctgctatctgtctaaaaattcaatgcagaaattcgttggtggaacggattaaggccatgagctgataaaaaagtatcttataaaagaatcacagaggacaattctgtgttgctggccgccgtaaaagtctattgtggagagattgcgtgaaattgaatagatagtttgaaactactcgttcaataagaaaataaattgtcctaaaatagaagcaattcaccctcaaactgttgagcatttgggttatttctgcaacatttgggggttaggatgacagcgaaaggagtgaaggactatgacattaccatttgaaaatgataccagccggattgtaaagcggctggcgaaacagaatatgaaagcaaaccggcgtacatccatttctatcatggtagccatattgatcgcatcaacttttttgtgttcgttatgcacattcgtccaaagctattggaatcaaagtgtgcagcaggagatcgcagcctacggtgattgggatgcacagcttttggagattcatgccggccagctggatttgattcagaataacgaaaatatccagaccatcatggtaaaaggagataatcagaccgccttattgccagctgcatccggcctgccctatcttttgatccaaaactgtgatggagcctattggggcggtatgcgggaaaagaatctgatcctgcgcggacgggttccccaggcgccgggagagattgtggttggaaaaagcttttttgagcagaatccatctgttgagattggagaccggctgaacctggatttgggcgaacgcaggattggaaatacaactgtggattttctttcccccattcaaagcggggaagaatttgtgaaaacagaaaaagtgcagtacaccatcgttggtgagattgatatgactgtttccagcgcatacaatggctaccctgcgtatgggtggctggacacggccgcattatcggaggacacggggatcgttgcgtatcttcaagtgacgcagccgcgaaaagtctatgaaatcatcccgcagatagcagaggacattggcttgcagccggatgaatttggtgactatcccttccgttaccacacagccctgcttgggatgtatggaatttatgcgccgggacatttcctaagcagtgaccttcccaaacttgcgcttgcgctgggtttggtcatggcagcatctatggcggtatttgcctatatcattcggggcgctttttctatttctgcgaaacgcaaggtaaaggagctgggaatcttaaaatccattggaatgacgcccaggcagatccgcatgatgatcgtatatgaggcgcgctggctgtctgtgcttcccattctggtttctgtgggacttggataccttttttcctatggcgtattggcagcatactctgacctgacgcaggaagtgaccgggagccggataacagcttccttttcgccgtgggtcgcagtggtttccgtgcttctctcgttcctgacggttcgcctggctgcttctggtcctgcccggcagatgggaaaacttcgcccgattgaagcggtcaaagaaagctggaacaatccttctttgaaaaaatcagcaaagcatccgattctgaaaaagtgctttggattccttggaaatatttctgcaaactccatgacggctaatatgaggctgtttcgtacctgtacggtaacgctgagtctgtgtatgcttttgatgttcagttttctggctgttttttccgtttcagatattaacaatacaaaagcagaacaggacagccactttaatgtcaatcttaccatggaatctggtcagaaaatagagccagcgcttatggatgaattgaagcagctgcctcatatagaagaacaggccacctatacgatggcgaactgtgcgctctgggtttcagaaagtgagctgtcggaagaatttctttcctctggaggatttggcacaaaagcggctggtgagtatgtagcaaagcgcgatagtcgctaccgtatcccatgtgtattgatcggtctggaacaggatgcctatgaaaattatctcatgcagtcaggggtgccttattctgaacagggtgctgcgctcattgtcaattctgttgtgaaaaatcctgactccagaggttatgaagccaaaaaagatatggttccatatctaaaactcaaagaaggtcagtctttagaagtaacagagaagttcctggactccattcagggggattaccgttttgatgtgacggtgtcatctgcactttctgaaatgccggagattgggcgtaatatggccttttatacattgcccattctggtgccgatggatcaatactatgagattatacagaatttcggagaggatcgtgcggtttacaattacagaacttacatgaatcttctcgtggaagatgggctggatgccgaagtacaggcgcaggcagagcatatctgtggtacttatctggggacgagtgatttctatacctccagcaagactcagcgcgctttggacagagagcggctgaccgatgcgaccatgctgatcgtttacagtttgactgcactatttggtatcattggaatctcatcggcagcagtggcgattctgaacagtctgtatcagagaagaaaggaatttgccatgctgcgttctgtggggctggatagaaaaggtcttaatcgtttgctgcatatagaagggttcttccttggaggaaagcctttggtcattggattgccgattctgtttttgattgccgcagttttgatgtggatgcaggatgtgacttttatggagttcattcaggtatttccgttattagggctggcagcctatattgttctggtactaatggtcatcagtgggatttacagaacggcttccagaagaatccgcagggatattattgtagaagtcttaaaggatgaaaatgtgtgagtcttactgcaaaatgaattgtcctaaaattgaagcaattcaccatggattttcatgccatttaggacaattctgcaacatttgccctttactctttactcaacaaattaaagcacacttataacaggagaaaacaccatgaaaaaaatcaatttttgcaaagcaacaacaatcattttaataatcaatgttattttatctattgttttatttttcgttgttcctgataatatagcaattcaatgggcaggtacatcccccagaaatgcagtagattcttactatatatttttagtaccggtattgtcagtgctttttgcttttgctggaaaacctatttttacaaggttcctgtttagattgtggaatagaactaacgagtatttagtggcatacctaaatttgtgtctgcaagttgtatttcttacttgtgaaatctatatcgggttatataacttatgtaattttaatgttgccattagtataattctcattgtggaatttatgataaatgtggtgattggattgaaattatttcacaatcaatctatctaaaaaatcgtgtagtatgtttcggcggacagttatttctggatgcccgctgtaaatttttttgaaatgtccgagcgttgtaacatttctcggacatttgggttttataatgatcttatcaacaaaagcaagcgtatacatgaagcaatgcaataaaaaagttgcttgttcaataagaatatgaattgtcctaaaattgaagcaattcaccatagattttcatgccatttaggacaattctgcaacatttgctctttactctatactcaacaaattaagaaaggcaggtaactgttatgaaaattttgcagacaactgatcttaaaaaatactacggcacagagccgaacattacccgcgccctggatggcgtgaacttctctgtggaggagggcgaatttgtggcggtggtcggcacttccggctccggtaagtccaccctgcttcacatgatgggcggtttggatacccccacctccggcagcgtgatggtgcgggataaggagctggcgaagatgaacgacgagcagcttaccatattccgccgtcgcaatatcggctttattttccagaactacaatctggtgccgatcctaaatgttcatgagaacatcgttttgcccgtggaactggatggggatacggtggatcagaaattcatggcggatgtggtgtccatgctgggactggaggataagctgaagaatatgccaaacaacctctccggcggccagcagcagcgtgtggctatcgcccgcgctctggtgtcaaagcccgctatcgtccttgccgatgaacccactggaaacctggacagcaggaccagcgccgatgtgttggggcttttgcagagaacgagtcgtgaatttaaccagacgctggtgatgatcacacataatgatgccattgcccagcttgcagaccgtatcgtgcggattgaggatggcaaaatcgttggataaaggaggtggcagacatgacattgccttttgaaaatgatacagggccggtcattaaaaaattggcgtcacgaagcattcagacagataagcggcgcaacctgtttgtgatcgtaacgatcgctctggcagccgctttgatggcagcgattttttgtgcaggagcgggaagtgacagaaaactggaggcggacattcggggacagtatcaggcggttgtggtgaattgtgaccgtgatacgattgaaagactgaaagactgcccggaagtggaacgctggggcctttcccagaattacggttctgcccgctatggtgacagcgttctgactgtggagtatgcggatgccaactggatggaattgggtaagaagccttcctttactgggacacttccgcaggctgccaatgaaattctggtagaacgggcatttcttgattattttgaaatccccgcagaagtcgggcagaccatagaagtgaatcttggaaacggaaagcagacctataccgtcagcggtatcatggatgtggagaatgactcccgtatgttccagctttatgtatctgaagcatttgtggaggagatggcgcagggagagccgctgtttgaatttcggcttcgttatactggtgctgatggtatggagctggagcagctcaaggcgggtattgcagcattcctttccgccaacgatgtggaggaggatcagattttttacagctccaactatttcgatatgcaagggtttaagaccggtgtgatgaaatattacattccggtggcaatccttttgctggttgcctgtgccgtggtcatttacagtatctttttcatttccgtaaagggcaaaatgcgggaatatggacgcctgaaagtgatcggcacaacaccaaaacagatccggcggatcgtgcggcgggagggattgctgttatctctttgcggtatcccgctggggcttttggttggaggggctatcgggtttgccattttcccggcacattggagctgggtgggcaatctgccctatctggctgcgaccgcagcagcctgcgccctgacggtatttctgtccattcatgcgcctgtccgcatggcggcgagggtatcccctatcgaagcggtccgctccagtggttatgaaacggcaacagaccggaaggatcagaaaaaccaccgcattacgccgttctccatggcacagatgaactttaggcggagcaggaaaaagacggtcatcactctggtatctctgggattgacaggggtgtttctggtaacagccgctacggtactcaactccatcagccccgaaaagatggcgatagaagccatgggagatcactgtaactatgaggtcagctggatggattcgggaggagcggaaggattgcctgccatcgcgcgggaaaatccactgacagaagaacttcgtcaggagcttcttgccatagatggtgtggaatctatcaccagccatgaagtgacatccgcaacggtgaaattcccccaggaaagtgttgcattaaagttccctgtatttgacagagagcagatggaacaatggctgccggaggaaaatctggaacagggcagcgcagattatgaggagcttgctgcaaacaacggtgtggtcgtgaccgattcggaagaccatcttttgagtatgttttatggctatacgcctgctgtcggggatgtgctgacctttgaatccatggacggtaagagcatagaagtaacggtcatggggattgcgaagccgtcagtgacatcaggcaccggcgcatggggtctgtttacccttacagaagaactggccgatcagctctacccggacattgagaacagagaggctgtttggaatgtccacacatcagaggactcggatgcgctcagggcgtctattttcagtctgctggaaaatccggtgctgacggtcttttccagagcagaccatgcggcatccctggaatcgcagctaaagatgatgacccgcggtgtttatctgctgctggcattcctgtttgtgttctccatggtaaatctggtcaacaccctgatgaccaatctgctggcaaggcagcaggagcttggaattttgcagtctgtgggaatgaccggaaagcaggtttcccgtatgctgatcgcagaatgcctgtggtacgcaggggttacggtatttttgtcagttggcattggcggaatcctgggctggatttttgactatgtgatcagcaactttaatatttttggggaactgtcctatcaattccctttgatggaaacggttgtttttgttctggcacttttggtcgtgaccggaatcttctctgtggttgctgtccgttactctaaacggctttcccttgtagagcggattaagaccatggactaaccagaggcggcggcttccgatgtgaagccgccgctttgctgacagcagaaatataagacttaaaggagatgatcaaaatgacagtaccatttgagaatgatacaggaaatattgtcaggaaactggcaagaaaaagtttgaaaagtgagaagcgccggaatcttatggtggtgatcgccgttgcgctggcatcctgcctgatctgtttttcgattgtgatggctttgtctacccggcagatagagaaaaatcatgtggaggatacctatgaggcagtctataccaggattactgaagaagatgtgtctaccctgaaggggctggatgacttctcaagggtaggagagtattatatgctggctgtggaacctgcggagcagggatataacgcctcctacatttattgtgatgaggaaaccatgtatattgcccgtgaccagatgaagcttttggaaggccgcctgccccaaaaggaggatgaagtggtagtaagccgttatttcctttccgaatatggtgcagacgccgggattggcgaaaaggttatgctaagcagcgagagctttcacggagaatacacggtgactggtattctggaaggctataaggaaaaagaggtaaatggctgttctatccttctttccaaagaagatctgaaaggatggagtggctatgaccccgctgattatcgagcctatgtgcattttcagaatgagcagcaaatggatgaaacagagctgactgcccgcagccgggagattgccagggaatatcagctggaaatgccgatcatgaacctcagctatatgaagttctataagcagcctgtgaatgtcagtatgctggcgctggttgccggaattgcagttctggttatcatcggagggtatgttgtgatacaaagtatcttccgaatttctatcaatgacaaaatccaaagctatggacaactgcgaaccatcggtacaacgccaaaacagatccgccatattgtcaaaaaagaaggccgtttcttaggatgggctggcattggtatcggtattttgctgggatgtgcagccgggtttgcgctgtttccccgtgggtttaatctgctattttatgcagccgcgattgttttgactgcactgcttggctggtttatggtatccattgcgatccgtagaccggtaaagattgccgccggtatctccccgattgaagcagtccgctttaccggcaatcagagcggaaagtcccacgcgcataagaagaatatgcggttaaatcccctctccatgggaattgcaaatttcaggcgtgaccgcaaaaagacgatcagcatcgtggcttccctgagtctgggcggggtgattcttttggtgacagcctctattcttctggttcgttcgccggagcggatcgcaaggcagtttttcccggatggggattataaaatctatatgaactctgaaaaaacagaatatgaggtaatgtcggagggaaatcctttgaatgaagcgcttcggcaggaggtgctggccgtggatggcgtaacagatgtgatagaaaatcgtcaggcggttcatgtgcggtttgaaaatgaggaaagttcttccggcggaatgtgtgatctgttgagtgaccgaaacagggatcaaatggaagcggcgcttgtgtccggaactttacctcaaaattcccatagtattgcacttgatatggattatgcagaagatatgatcggtgtagatgtggggtcagttatcaaacttaccataggggatcaagagattcctgtcactgtttccggtctgctcataaacgatgggcttaaaaatggtcatggtcctctggcattggacagaacctgcatggttgcaaccaaagagctatttcaggaagcaatgccaaagatcaactgttttgattattcttggagcattgtcagcgatcccaaaaaggcggagcagattgaaaacagtctgagtgcgatcatttcttccaatccggatcttgacttggataccattgggatacataaggattatgaggaaatggaaaaccgggtcgtttttggagggtttcaggcgctgtcctggctggtattcctctttggcgtggtcaatctcatcaacacaaccctctccaatcagatgtccagaaagagggaaaacagcgtctttcgtgccatcggtctgaccagaaaacagctctgtcaaatgaccatctatgagggaatttgctatgcgttttctgctgcgttggcaaccctggcagtcggcctcccgattgcaataatagctgcccgaaaattcagcgaaatgacttttcatgtagcaatgccctattccttccccttcctgcaaatggggctgttcgttctggtgctgtttggcctggaggtgattctgtccttctggacgatgcgcaggcagaaaaatcaatcgctggtggaagaaatgcgagcgatggaataatcgtatggaatcggcggggcggcagtgcgctgccccgctttttctattatcattttaataagttaaaatcagggatggatatatgaaaaagatactgttgattgacgatagtgatacctatatatggaatctgagaaagtatttacagcgccggggctattcagtgaaaacggcttccactttgaatgaagcgcgggctgccatccaagaggaaatgccgctggtggtctgctgtgatcttgacctgccggacggttccggcatggactttctggacgaggtgcggatcacagataagaagctgccttttattctggtgtcctgtcatgacaaagacgactacgaacaggaggccatgcgccggggggcgacgctgtgcatggacaaaatgaaaggtccgctgctgcaagataagctggtggaatacgcctaccggcagttgtccggcgaaaaggccccgacttttcacaagctgctctttgtccatgcggaagataccagtgccggagtgctgcgggcggctatgctgcaaaagggctttgacctgattctggtttcctcgattggggaggctaagcgccggatttttgaggataaggaaattgaactgatcctgtgcgatctggaactgccggacggcacagcaatggagctgtttcatacgctgcggcgggtggctgggatgttccaagtgaagaatccccctgtccggcttctgccgttctttatcctcaccgagaacaacgaccttgccatggaatatgaataccggcatgagggcgtgaacgactatatcaccgccccggtcaatatcccggagctgatccggcgagttttgttctttgtggaatgaagcttttttattcggcggctttgttaagcaaggccgccatttttaattcatttatcttcaatgtttgttctgaatatcgtataatgtaggggaacggctgtggtttcatagagtggtgaggtgtttatattatgaatgaacgagaaaaaacaatccgattatggtttgatatgtggctcaatcagcaggatatggggattgatgatatatttacagaagatgtgatttatacagaaagctggagtccccagtataacaaccgaaaaacagtaaagcattggtttcaggaatggaatacccgtggcaaggtggttatttgggaaatcaagcaattttttcataagggggatcaaacggttgtagagtggtatttcaaaaatgaaatgaataatggggatatagaggaatttgatggaatctcgctggttgagtggacagaggataataaaataaaggcattaaaagaatttgggtgtaatcgcaatacctataatccataccaggaaggcgatacccctcaattcaaagcagaaaaagcgaattggttttgatggagtgcttataatgttagcggctgtggtttcatagaaagttgagggatttttgagatttttgatatatcatataaagaatggaggtgcatgattttgaatcctaaattactggtcgttgatgatgaacgcggtattgttgatatgatacagagttattttcaaacacgatatgatattctgaccgcttatagcggccaagaagcactcaaaaaagtagcctacaaaccagatttaattttattagacatcaatatgcctggaatggatggcctgactgtatgccagaagatacgggaacacatagcctgtcccattctttttttgactgctcgtattgaatccagcgataagattattggatttcaggccggggcggatgattatatcgtcaagccctttgatttggatgaattgggggcgcgtattgctgcacatttgcgccgtgagcagcgacgccaaaataattcggcagtacgcttctttggtgaattgatactggactattccgcccgaacagttacaatcaataatcagaacatcccgctatctaagagggagtttgagattgtagaacttttatccctcaatgcaggacaggtttttgatcgtgagcggatttatgagcgtgtgtggggattagatggggacggaaacagcgatacaattatggagcatatccggaaaatacgcgctaaatttgcagcacatacattgcacaattacattgaaacagtttgggggtgtgggtatcggtggaacgcctaaaaaatatgggactaaagaaatctttcctgttattatccctctcctgtttagcggtggcatttctcctgcttggtgcggttatctttctttgccgtggcattgaaaactattatcctttaggcggtgtagaaatcctatcggatggttcaatcgtacccctgccatctcctacggcgtcacaacagcgcattttggctatcctaaatattgtgcagacgctttcctgtattcttttcccggtaggtggattgattgtttcagtctttcttttttattatctcaaattgaagcagcctatttcctgcctgcaaaatggcattatgcggattcagaataatgatctggatttttcgctgccgattttgtctaatgatgaaatgggacagctatgtgctgcctttgaagaaatgcggagtgaacttttgaaatcgaatcggctgttgtggcaacaggccgaggaacgcaaacggctcaatgccgcattttcccatgatctgcgtaacccgattacggtcttaaaaggaagtgtaaaacttttgcggcaaggtattcaggatgaacagaccatagaccggctggaaagttacactttacggatcgagcagtatgtagaagctatgagcagtgttcaaaaattggaacaactctctgttaagccaaaagaaatcagactatcagttttacagagtgaattgcaggaaacagcacggctgttagcactatccaaaaaagtttctgttttagtaccatcaggtggaacagtttgtatagatcacgggctatttcttaccgtagcagaaaatctgattggaaatgcggcgcgatttgcagaaaaagcaatctctattcaaataacgctgcaaaatgattctttggtcttgaaagtagaggatgacggtgcggggtatccgctgtctctcgtgcagaatgggccaaatccctttgaaacgacaagtagcaattcctcacatttcggaatgggactttacagcagcagaattttatgtgaaaaacatggtggacgattgattttgggaaatcaggccgggggcggtgcatccgcaactgccatttttcatttcgtgtaatccttgagcaatttttgagatttatcatttacactctccttataccacaaataaggagagtgttttttatgaatattgaggcaaagaatttatcaaagatttatggtgatggtgaaaaccgagtggtggctttggatcatgcgaatctcgaaattgtatccagcgattttatttctattatgggaccatctggaagcggaaaaagtaccctgcttcatttgctttccggcttggataagccatcttccggttcgctgacctacgatggtaaagatatttacagttacagcgataaggagttgtcggcattccgccggaaacggatcggatttatttttcaacaatttaatctgcttccggttctgacggcgaaagaaaatattatcatgcctcttttgctggataaacaaaaaccggatgaagcatacctgaagcagcttacagaactgcttggcattcaggggcgcttggaacatctgccccatgagttatccggcggccagcagcagcgtgtagccattgcccgcgctttgattgcaaaaccagatgtgatttttgctgatgagcctacgggaaatctggacagcaaaagcggcggcgaagtcatggaactgcttcaaaatgtatggaaaaagatggggaaagctctcgttgtcattacccatgacagccgtattgcgcgaatggcagaccgccagtttcagatcgtagatggtgtgcttgcggaggtgacagcgaaatgaaatcttatcgtacattagcattaaaagaactgctgtcccaaaaagtcacttctattcttattttgattgccgttgtgctgtctactatgatgacaaccattgtaggacaatccattggcgtacttagtgcaatgcgggaacagcaagccatcgctatcggaggaaaccgatatgccacttttttgcagatgaatgcagagcagcttcacgcactggaacaggatgagcgcctttcctatgtagggaaatctatttatatgggaagtttagaactctccccatctcttacccttggtttgatggaatattgggatgatactgccgctatctatccatccagtaccagtgtagaagaaggtcgtctgccggaagccccgatggaaatagctctttcggaagatattctgaaatatcttggctttgagggcggtattggagataagattacactttcactgcaaaaaaatcttcgccacaacattgcggacagctattcctatacagcagaatttgttcttacagggatattgaaaaataactacttgggatatacaagcggcactgttacgggagttgtaggggaaggaactgctgaacaacttttaacggaatcttatatttattacaatgtggatattcggactgccgataaaaagaattttcaagcagttgtcgatgacatcaataaggaatttaatatccatgagcttgataccagctataatattgtatatttgaacgccttgggaatttcctatactgcaaattccgagggtgctaatgataagggattctcttttatgacagtcgcagggatattagtgggtactttgattttgctggctgctggtcttgtgatttacaacattctgaaaatatctgtatcaaaacggataaagggatatggaacacttcgggctattggaggcgaaaaaggacagctttatcagatcattgtaattgaagtaatcctattgtgcctgatggggattcctattggtatgcttcttggtttcctgagtgccagaggaattttagaggcagctaccggcctggtttcccctgaattgttcttggttcaggatgcttctgaattgaaaactctaatagcagagaacagttctttgaatggaaccttactggttttaagcggagcaatcactttggcgtttgcgttgtttgcagcattaccagcagccagatcagccgcaagggtatctcccattatggcgatgtctggaacaaatctaaaaattcggcgcagaaagcgtaaaacaaagaaaatccataattttgaagcatattatgcccgcctgaacttaaagagaaataaaggccgtactgcaattacaattttgtcccttgttatgagtatcacggtttttattgccctgcaagggttttcctctctcctgaacgctgcaagcgccctgcaagataatcatgtaggagattatcagatcacaaatgaaagtattggatttaccacagatgatctgaacactttgcggaaaaatgaagctgtgcaaagtgtagccgccatacaattttcgctttacgaacaaaatgaaaatgggctgctcgatgaaatcagtcttgaatttcaactgaaacccggcgaaacttttcaggttgtcggattgaacgatgaatattgggattattttatgggggatcaattaccagaagaacagcttggacaactgaaatcagggaacgcctgtatagtaaggaatcctattcccatgagctacggcgaagatgttcttgaatttacaaatatagaggccggagaaagcatctgtgttgcgggaatggagctgaatgttttgaaaaccttggatggctatgacggttatcttggtattggaaatggcggtttcacaaatggtgttcaagtgatcgttgatgatgctatctatgaacgcctgacgggaaaagatacctattcagagtttttgcctacactgaacgagggtgctgacagggaaaactttgatacatttatcgaggcgttttgtaacagaataccggggacaacattcttgtcatatgaagaaaccgaccagcaactaaaagagagctttgcacaaattcaaatgctggcatgggggctgattcttttcgttggcctgattggtattcttaatatcatcaataccgtttacacaaatattcacaccagagtaacagaaatcggtatgcaacgggccattggaatgagcgccggtagcctctataaaacttttctttgggaaggtgcatattacgggattattgcctctgtgattggaagcgtgctgggatatgtttgtacgattttcattgaggcggccacgagcgacaccctccagcttgttgcaattcctgtcatacccattcttgaagcaaccctcttggcagtaggagcctgcttgatggcgacagcaattccgctgcggaaaatttcaaaaatgagtattgtagattccattgaaacggttgaatagattttttgattggatgttggttcttgaatagcttttctctgactgaaacgagataaaacttgaattgctacaaaaatgaagcaattcagcctgttttcttgctgaaaaagaaagcgattaggagatttctgcaacatttggtttttatcatagaattaaaagtaagatagaaaatgtgattaaatctgccgaacgacggcaaaagaaaaaaagccgtcgtacagcagacatatttctatgcacctatgaagtggcggctttgagaaatcagagccgccgtttctttttgtttttccaacgatgctcatgcgattaagagggcggtacacaggaggataccgccatggcaattatcatcattcatagcacccatgagcttcatcaattaaaaaaagtcttgttcctcctccggggaggtatgactatcaatcagtattatcattccatctaaatcagcaaaatagtaggtatttttgttgcgccagtttccaattgtggggagctggcgctttttggtatcggtttttcgggaaagcccccgaagtatgtcgctgccgatcaccacctccattcgattcactcgctaatcgcccatgaatcgaaatggaggtacataatgaagaaagtcaatcttagggagttgtatcctgatatatacaaaacggatgtttttatagaagtaagcagtgaagtacaagaagtattcctgacagataagcgagcagaagctgcacgccagcgccagatgtataactacaaagcgtactattctctggactgtgataatggtatagagaaacaggtagtgtatcagccgccgacgccagaaatgctcatggaggaaaagcagcttcgagaacagctctattctgcggtgatggccttaccggagaagcaggcaaagaggatttatgctcggttttatctgggtatgacagttaaagaaattgccaagacagaaggcgttgatctcagtagagtgtatgacagcatccaacgcggtttgaaatggctggctaaaaatttgaaaaagtttgattagcatagcgaaaatcttgctctttttttcattactattagaaggacaagttttcccccttcaacagcactttgacaatttcatagacagcataacaggtacataacccgtgtatgagcgagtgtgggacgccgcgaagatggagcagccagggaggtgatgaacagagctgtttcggagcaatctacgattccacaaagcggatggtggcagatccgccgcgaggactgcacgggggcttaaagatacttcctcacggcctcctaaagacttggggggaaccctgcggcgcacgagtaaaacgacgctgcggagttatgacaaccgcgccagcggagacctgttatgttcccatcgtcagggttgcgtggcaaatgtgacgagtaaaataagtaataagtaaattagtcaacagccatattgggagagagcgtgtatagatagcacctcatcaataaccagtatggctgttttttggatatatatggaggatatatgattatgacagctgtaagtgagaaagatgctgttatctgtatccatgacgattattgtattgatattgaagcagcagaaatctcacaaattttattgaagataggtgagcttatttctaattcctatcgcagtacgaaggcagagaaattaagtgaatcttaaagcatagcaagcttctttctcataagcaaggatgtggaaacattaatccgtatctttgcgaaaaggaaaagtgttgagtaaaatggtaacagaataacccgcgggaaggaggtgtgataatggaacggtatttgatgtatttgaggaaatccagaatggatacagattttgacgaaatttctgttgaagaaactttgaacagacatcgacgcattttagagtctttttgtaaggaaaggcgattaaatgttgttgatgtcttggaagaagtagtttcgggagaatccttgtcgtccagacctaagatgcttcgtttgctggaactggtcaatactggaatgtatgcaggagttatttgtattgatattgagcgtctttccagagggtcatccttggaatccggttatatcatgcaggtacttcaaacgaataattgtaaaattatcacaccgtccaagatctatgatcttcagaatgaatcggatgaacagtttactgatatgaagtttatgttcagccggtacgaattgaaaaccatcacaaagcgcttggttcgcggaagaaatcaatcagcttctgagggcaaatttcttggttcagtagctccgtatggataccgtgcctataaactggttggtatgaaagggaatagcctgcgaattgaaccgaaagaagcaaaagtggtgcggatgatttttgatatgtatgggaaacaaggaattggctacaatacgattgcccatgaactgaatcaaatgaacattccatctctaactggtacatgggggcaaacatccatcacaaatatcttaaataatgaagtttatttgggaatgatccgctggaaacatgaacctacaaagcgagtagttaaagacgggatgcttactaagaaaagagttaccagtaaagactatgagttgtatgaaggattacatgagccaattatagatcaggaacagtgggatcgagtaaaagcagttcagagcagtcgtaatcacgcatcagttcataaggataaaaaacttatgaatccatttgcaacaattcttttttgtgaaaagtgtggagcagtaatgaagcggaatgttccggcgaagacccaaaacacttctccatggtacagatgtccaactcgtggatgtaattgtcggactataaaatgtgattttcttgaagcagaagtggtgaaagccatgtctcaatggtggggtgagtacactattaaaataaaggaagataaggtagcacaaacggactctacggagacggcattgagtattgtaagagagcaacttacagagcttcagttacagcaggataagatatgtgaatatctggagaagggtatttatacaatagaaatgtttacaaagcgaaatgataccttaaccagagaaatacataaagttcaggcagctgaaaatgagttgctgaaaaaacagggggctcaaaaagatattcatgatgtagagaaagaaataattccgacaacacagcacattctcgacagctatccacagctttctgttgaagaaaagaatcgtttatggaagattgttatggaacggatcactgcttaccgtacaccaggtggagaagttagcattcacatctatcctaaacttcctatgcgataagtttatattgaaccgagtgcaacagcatctcgaccaacgcctccttttgtggtataattcaatattatgccatcagaagggaggcgtttttatgggcgaacagaagcctgaaaaaacgaaaaaacatatatgtgctggtctgttggcccatgttgacgcaggaaagacaacattaacggaaagtttattgtataccagtggtgcaattgcagaactagggagcgtagatgaaggcacaacaaggacagatacaatgaatttggagcgtcaaaggggaatcactatccagacagcagtgacatcttttcagtgggaggatgtaaaagtcaacattatagatacgccaggccatatggattttttggcggaagtataccgttctttatccgtattagacggagcagtattattagtttctgcaaaggatggcatacaggcacagacccgtatactgtttcatgcactacagataatgaagattccgacaatttttttcatcaataaaattgaccaagaggggattgatttgccaatggtatatcgggaaatgaaagcaaagctttcttcggaaattatagtgaagcaaaaggttgggcagcatccccatataaatgtaacggacaatgacgatatggaacagtgggatgcggtaattatgggaaacgatgaactattagagaaatatatgtcagggaaaccgtttaaaatgtcagaactggaacaggaagaaaacaggagattccaaaacggaacgttatttcccgtttatcacggaagcgctaaaaacaatctggggattcggcagcttatagaagtaattgccagtaaattttattcatcaacgcctgaaggtcaatctgaactatgcgggcaggtttttaagattgaatattcagagaaaaggcggcgttttgtttatgtgcgtatatatagcggaacattgcatttgagggatgttattagaatatctgaaaaagagaaaataaaaatcacagagatgtgtgttccgacaaacggtgaattatattcatccgatacagcctgctctggtgatattgtaattttaccaaatgatgttttgcagctaaacagtattttggggaacgaaatactgttgccgcagagaaaatttattgaaaatcctctccctatgctccaaacaacgattgcagtaaagaaatctgaacagcgggaaatattgcttggggcacttacagaaatttcagatggcgaccctcttttaaaatattatgtggatactacaacgcatgagattatactttcttttttggggaatgtgcagatggaagtcatttgtgccatccttgaggaaaaatatcatgtggaggcagaaataaaagagcctactgttatatatatggaaagaccgcttagaaaagcagaatataccatccacatagaagtcccgccaaatcctttctgggcttctgtcgggttgtccatagagccgctccctattggaagcggagtgcagtatgaaagcagagtttcacttggatatttaaatcaatcgttccaaaatgcggttatggagggggttctttatggctgcgagcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgctagatgtattcaagaatacaggaacgatttaacttatttcacaaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggattagagactaattatgatgaaatgcgaatggatattgtgtcctgtttgtgggagcaaaacccgtaataaaattaggaaggacactgttttggagaattatcccctttattgtccaaaatgcagacaagaaagattgattaaagttgacaacttgaagataactgtcatcaaagagccagacgcttaagacgcagagccgatgaaattgtggaacaattcacgaatcatcggctctttttgtttcgtatttgaaagaacaaactcaccaaataaaaaaaacgatattcgggtgggttattttgttataccctaaattaccctctgaatttgtttttaaatttggagggatttttttatgtccttttttcgggcagttatctatctgctcatacgaagcaaaatttatcaatacatagcatatcagagaacggcaggaaaccagttaaaaaaatttctgccagtgcaacggtacttctcaccttgaaagtagaagtacaatctccatacaatagaattactatttcctataaccgtaaaggtcacagagcctttgcggtttttcttttgtcgatttttgttggaaagtgccgtagggctgtttctgatatgcggtgtcgttctccgcctctccatctggattttttacatttcaaaaattcagatgggaggtatttatggtgaaatatgcaccaagaaaggtatatatcagagaaagtggcggctatgtggaattatcctacacggagttctgccgttgcagggaatccgaccagacctatatggacaagctgtttatccccattcaaggctgtctgcttgaagtcgtgagggagcaatacacagacttctaccgtgacaaggaacggtggcgttatctgcaaaaattagatacaaagaatagactgctatctctcgacggatttacggacagcgaggggaatcctctggactttatcactgatgaagcggtggacattgcagaaaccgttgtcaatgcggtcatggtggacaggctgaaagccgccctgcctttgctgtcggatagtgaacaggagctgatacaggcaatcttttttgacggactttccgagcgtgaagtcggggcgaggttgggcataacccagagcgttgtaaacaaacgcaaagccagaatcctaataaaactaagaaagataatagaaaattaaaatttaaggcgttcagcccccttgttttttcctttgggaagatgagggggcttttctctgccctctcaatcaattctgattggaggaagtaagaatggcatacaaccacggacgggaggacaggaaatggcgtatctggaaagaagcggaggaaaagctgctgcgtgagtgcggcgttgatgaagcgaccattgagcagatacgcatggcggacagggcagacttcaattccaacaggcggttttaccgatggacgaatgacgttgcggaatatcttgaggacatggcaggcagggagcggcaggcggaagtgggtacggttgcggagttactggaagagattgagagcgaaaatctctatcaagtattagtcacggtggacgggcgtaccttgaaaatcgtcctgctgaaaatgcaggggtattccacaaaggagattgccccgcttgtgcatttgacgactggtgccatctatgcgaggttagaccatctgcggaagaagctgcggaaaattttatagcttctaaaacagcctgccatcctgcgggctactgggtgagggatggaaatcccctcactcattttttgcaggaggacaacaggatggcatacagggttaaggcatacacgcttcgggaggaatccacggaaagcggcacaaggtattttatcagctttaaggacgggcagggcaaatcccacgagttggaagtgtcggaacagttctttatggagtttcggcagatggagcgcaggaacaggaatcttttctaatgggacgagcggcacagggagtttaacgaggtatgggacgaaaccctttacagacgggcgttgcgtgtgcctaagagccttgatgaacgcatggttgaggaagaacggaatgaaacgctctataaggcggttgggagccttccagagatacaaaggcggcgtttcctgctctactacgagtatgagttcaatttttaccaaatcgccgctatggagcattgcaccgcttcggcaatacagaaatctgttgcgattgcaaaggagaaagtaaaggcggaaattgaagaaatatctccaaccgtgaccgacaccgcccgaaaaagaaatctgttttttatttgtgtgggattggcggcattacatactctcacttttttccgtgggagtaaatctatttttaaggaggtcaacgcctatgtgcaacgaaaacaaagacaccgcccgaaaggaggaaagccatgcagaagttacagacagtcaacgccgaaacgctcctttatgaaccgcttgagaaaccatcctttgtggtggacagccttatcccgacaggcttatcgctgttctgcggctcacagaagataggcaaaagctggctcatgctgaagctatgcttatgcgtgtcgcagggaatccctttatgggatatgccgacaatggagggcgatgtgctttacctctgccttgaggacacgttctgccgcatacaggacaggttatttcgtttgacggacgaagcaagcgggcggctccactttgccgtggcaagctgcaagctgtcagacggtcttatcgtgcagcttgaagattatctgaaagattacccagacagcaggctcattgtcattgataccttgcagaaagtccgtacagcttcaaaagacaatgcctatgcaagcgactatggggacatctccctcatcaaagactttgccgacaggcactctctggcggtcattgtcgtacaccacatccgaaagcagaatgacagcgacgtgttcaacaaggtgtctgggacgacaggattaacggggagtgcggacgctacctttgttctggaaaaggagaaacgtgcgtctgacaccgccaagctgtatgtgacgggcagggacacgccttatcaggaatacacgctgcgtttccgtgattgccgttgggagcttgtggagcggaaaacgcaggagcagcttgcgaaagaaacgataccagatgtcctttttcggttggtggattttatgagggataaggaagaatggataggcacggcaacggaactgttagccgctatgggggaaacggaaaccatacccacggtgattacgaaatggctgaatgaataccgcaccacatttttaagcgagaaccgtatctgctaccagtacagccgcaggaaagacggcaggcggattgcccttgcaaggagggcgggtgacagcggtgatggtggtgacagcgatattaggatacccccctgttactgtcattgacgcttaaagccatgtaaagctggcggctctgccctgcgggtgacagcagtgacggtggtgacagtgattttaggataccctgccgctgtcatccctacgggagaacaccccgtaaacgcaaaatgcaggcgtgagatttactcgcccttttcggtcgtgtaaaaccacccctgcggtcagaaaaatcattccgatttttccgactgcgtttacagggtgtaacacactacactttgccctgcaaagtcgtgtgccagacgttccctctggactcccttaaggcagggctgtgccctgctatcctacgccttacggcttcggataaaagaatggcggcatgacggtgacggctcttgcgaggggggtatcccaaaaacaccgtcatcatcgacatgaccgtcatgcagggggtgagggtgacagttgcggcagtcggcagggggtatcccaaaactgctgtcaccaccgtcaccgctgtcaccccaaaggacggtcacccgccgaaagaaaggaggaatccgcctatgccttatgcaatcctgcgtttccagaaacgaaaagcgggcggcgttgcggcttgtgaacgccacaacgagcggaagaaagaagcctacaaaagcaacccagatatagatatggaacgctctaaaaacaattaccatctcatagcaccaccaaagtacacctacaagaaagagattaaccgcatggtagccgaagcggggtgcaggacaaggaaagacagcgtgatgatggtggaaacgctcatcacagcttcaccagaatttatgaaccagttaccgcccgaagaacaaaaagcgtatttccagacggctcttgacttcatttcggagcgtgttggaaagcagaatatcctctccgctgtcgtccatatggacgagagaacgccccatatgcacctctgctttgtgccgattacgccagacaataagctgtcagcgaaagctatcttaggcaaccagaaatcattatccgagtggcagaccgcctaccatgagcggatgtcctcacggtggaatcagcttgaacgggggcagtcctcaatggaaaccaagcggaaacacgtccccacatggctctataaattaggcggcaggcttgataaacagtatgaagaaatcgtgtctgccctatccgacatcaacgcctttaacgcagggaagaaaagggataaagcgttagatttactctctgcatggctgccagacgtggagaaattctctaaggaaatcgggaaacagcaggcgtatatcgacagtttgaaagagagaattgggcaggaatcagactatgcggggcgtatgcgtgatgaaaagtacgagcaggaactaaaggtgcagaaagcgaatcagaagatatttgaattgcagagaaccaacgagcagatggggcggctgctgtcaaaaataccgcccgaagtgttggaagaattgcagaaaaatcatagaagcagagcgaaagaaaggtagatatgtgaatgaagaaacaggattttaaggtgttaaagaccaaagacttgtacccgttccccgacaatccgtttcatgtggcagaagatgaaacactgtcagagttagcggaaagcatcaaggaatttggcattgtcacgccgataatcacacgcccgaaagaggacggggacggttatgaagtgattgcaggacagcggcgtgtccgtgcttctgaacttgcagggataaataccgtgcctgcgtttgtcctgcccttagaccgtgaccgagccatcatcacccttgtagacagcaatttgcagcgtgagaatatcctgccatcggagcgggcgtttgcttacaagatgaaatccgaagccatgaagcggcagggtttccgcacagacttaacctcgtcacaagttgtgacgaagttgcggacggacgacaaggtggcacagggcttcggcgtgggcaggatgaccgtgcagcgttttatccgcctgacggaactgataccgccgattttgcagatggtggacgaggggaaaatcgccctcacgcctgcggtggaactgtccttcttgaagaaagacgagcaggaaaacctctttgccacgatggagagcgaagaagcaacgccctcactctcacaggcacagcggatgaaacagttaagccagagcgggcggcttgacatggatacgatatttgcgattatgacggaggaaaagggcaaccagaaagaaaccttgaaaatcaacacaagcaagctgaaaaaatactttccgaagaacacaacgccgaagcagatggaggaaaccatcatcaaacttttggagcgtgagttgcagaggaaacgcaaccgtgacagccgctaatcttcttttttcgggaagtaaatacagagagttgaggtatggagaatgagagaaatccagtatgaaatcgtaaaggaaatcgcagtattgtctacgggcgacagtggctacacaaaggaaatcaatctcatttcatggaatgggaaagagccgaagtatgacatccgcagcttttccccgaaccgtgaaaagtgcggcaagggaatcacgctgaacgctgatgaagcggcggcactccttaaagcattacagaaagaattaaacagcgaggattaatggtattgattggcagggcggggacatttccaaactcttccctgccctgtctggaaaggaagatttaagtatgggcgaggataagaaagcagataaaaagagaaagcgtatcgtgccaaaagcaccagtgcagatgataatcagccgtgaatatgtcggcacacagaccgttacagaagcgtttgtcccgattatctccgaggatattcggaagaagattgccgagggcgacaccttcgacaatgaggggctgtccgcttagaatgtacgcaatgggacatgaaaacagataggacagatacggaggttttacagtatggcaggaatcaaagaagaaaagaaaatctatttagtcggcatttattgccgcttatctaaagacgatggtacggataacgagagtgcgagcattgcgacacagaaatccatcctcacggattatgtgaaaaagcagggatggcacatagcaaaaacgtatgtggacgatggttattctggtacaaatttccaaagaccaagtttccagaatatgataaaagacattgaaagcggtctgataaactgcgtgattacgaaagatttatcccgtctggggagaaactatcttgattgtgggttatatctggaagttttcttcccagagcataacgtgaggtatatagcggtcaatgacggcgtagataccttgaataaatctgctatggacatcacgcctttccgcaacattttaaacgaaatgtatgccgctgacatatctgttaagataaaatcggcatatcgggcgaggtttcaacaggggaaattcatgggaactaccgccccttatggctatatcaaagaccctgccgaccacaaccatctgctgatagatgataaagtggcacatgttgtaaaagagatattcgaccttgcattaaaagggaatggagttgccaaaatttgcagacatcttaataaacagcatatcctacgccctgccgcttatgcggcggagcgtggcgaaacaggctttgaacgtcattttgaggggaacgaggacaaacgctatatttggagtgggaacagcgtgaggagcattttaagaagcccgatatatgcgggaaatcttgtaggctacaaacggattgccgccaatatgaaaagcaagaaacgcccctctaagctgcccgaagaatgggaagtgatacccaatacccatgagggaatagtcacgcaggaggaatttgatattgtccaacagcttattacaagtcgtaggcttccacagaacaagggaggatttgtaaatatttttgcaggcgttatcaagtgtgtggactgcggatgtgctctgcgggcaatgaacgtacacaggaggaaacgcccagagattatcgactgtgtacagtattcatgtaataattatgcaagaaacggaagaagcgagtgtagtgcccacaatatagaagcaagggatttattcaatgccgttcttgccgacatcaactgttttgcggatatggcagtgaatgatgaaaaggcggtcagggccatagaaaagcggctcacggaaacagaccagagcagggcgaaagcattagagaaagaacgtaagaagctgaacaaacgccttgcggaactggacaggctgttttcctctctctacgaggataaggtcatggagcgtattaccgagcggaattttgagatgatgtcggggaaataccagaaagagcagcttgaaattgaagcaaggctgaaagaggtgacggaaactcttaatgaaagctacgagaaatcacggggaatccgtgacttcctcgcccttatccgaaattatcaaggcttaaaagaactggatgcaacagttataaacgcactcatagacaagatacttgtttcggagcgtgagaagatggcagacggaacagtgaagcaggaaatcaagatttactataaattcatcggctttgtcgatgaattacatatcatacctacaaaacggtgggcagcaatgcccgctaaaaattgtacggtgtgcggcgttgaatatgtcccgggctctggtgcatcaaggtattgtcctgcttgtgccaagaagatacggagggagaaatcaaacgagagcaaacgcaggagcagagaacagaaaaggatagcatgtatgaactgtccgcaaaaaatgaccgactgatatcgaacagcaggagggaagaatcttacgacagggcaaccagaatgataaggtcaagatatttcgttatgttacggaaggtacatttgacagttactcatggcagctcatagagaataagcagaaattcatcggacagattatgaccagtaaatctccggtacgaagctgtgaggatgtggatgaagcggcactttcctatgcagaggtcaaggcacttgccacaggtaatccttacataaaagaaaaaatggatctcgatattcaggtatcgaagctgaaactgatgaaggcaaaccatgccagtcagaaatacaggctggaggataacatcacacagcattatccgcatcagatcgctattttcaaggaacgtatcgaaggttttaccgctgatatggaaaaatgtgcgaaaaataagccggaggataaggagcagttctttatgcaggtgggcggaaagccatacaccgataagaaggaagctggaactgcaatcatagccatgtgtaaggaaatcaaaggcatcaatgctagtgcggatgtaggggaatatcttggatttaagctgaatgtaacctttgattctttcaacaataaatttgtaatgaatgtcaaaggagccatgagccatccgatggaagttggcactgatccgctcggcaatatcacccgtatcaacaatgcgttggaagcaataccggcacagcttgaagaggcacagacgaaactttctaatgtggaacatcagcttgaaacagcaaaagcagaagtagacaagccgtttcagcaggaagcggagctatctgaaaagctggaacgtcttgcagagcttaattctttactcaacatggatgaaaagggcgatgatgcgattggtatggatgatgaagccgcagaaccggaaaaaccacaggaaactgtgaaaacagtggataacaaaagggacgaggtcgcagatatgccagcaaagcagagtaatcttgggaaaacggctatgggtggtaagctgtcagaccgaccggcagaacggacttcattgcaagaaaaactcgcagcaatgaaggcaagggtgtccgggacacctgcaggaagggattcagcggataagacaaagaaaaaagaagaaattttataggaaaatctattttattcctaagtttattcccaacctgtcagcattatttgggttgggaatattaaaaagtgttatagcagtttatgtaatggcagtccgtagtgactgctttttatcgtacaagatggaggtcgtttatggcagacaacaatacagaaaaacagcgtgtgcaggagcttacggacaaactggagcagggattgcaggacttattcaacagcgatagttaccgcaattatcttagtacaatgtcaaaatttcataattacagttttaacaacacgctcttaattgcgatgcaaaagcctgacgctacgttagtggccggatacaaggcttggcagaaaaattttgagcgtcatgtaaataaaggggaaaaggcaatccgtatccttgcacctgcaccatataaaatcaaagaggagagggacaagattgatccggtcacacaagaacttttacttgataaagacggaaatccgcagaaagaggaagtcgagataacaattccggcattccgggcagtatccgtttttgacctatctcagacggacggaaagccgataccggaacttacagcaaaggagcttctttcagatgtggaaggctatcaggatatgattcgtgcggtagaagccatttcgccagtaccgattgaactggaggagatagccggagattccaaaggctactatgacagggaagcaaagcggattgcggtgcaggaaaacatgagcgagagccagaccttaaagaccatgatccatgaggtggcacattccaagctgcacagcaaggaagtggagcaggatgagcagaagcgaaaagaccgcaataccaaagaggtggaagcagagagtgtggcgtacaccgtttgtcagcattttggtatagatacctctgattattcttttgggtatattgcaggatggagcagcggaagagacaccaaagaacttagatcttccatggacacgatacggagaaccgcttcggagctgattaccgggatagaggaacaattacaggaattgcaaagggacagggaagtatcacaggaacagacaaaggaaagtattctgctcatacagaatactgatctttcagagtttagtctgcttgatgtttatggtatggacagaccggaactgatgcaggcactatcagaaatgacggatgacgacaaattgagcatacaggcgtatttggaaagcaggggtgcatggacaacggaaatcggcaatcaggattctagagagtatggagagtatcatctggatgtgcgttataacacggatacggatgagctgattgatatgaaggagagaaaggcagtctatgataagtcaatggagccaatcaatgccgatgatgtggttgtcaagttcgcttccgcctttgaaagcgaatgggaggtcttaaaaatcacaaatatgtcgagggaagatgtcggaaaaatgctcaaagatatggcttctcttgatgaaaatgaatgggatggaaattacctttcatatatggaaaagcagggagcggaaatcacgttacttgcgtctagtagtaagggattgaatggaaatctgccggatttttgggattatgaatacgattttgatgcaggtctgacggatgtggaggaactgtctgccatgcaacaggcagagcatatcattaaccggttggaacatggacagcctgccttttccgatgatgaaagaaatttgattgtaaattatgcttataagttgggtaatgtggagaaaacaagggagcttgcagaacatatctatgcacaggaagtggatggaaatcaggatgttgcattagcaatgattgatgcacaggcagaaatcgacgcacttccggatagcatggtaggtgtatctgaaatgcaggaatatggctatacatggaatgaaatgcttccgttgacgcaggagagggcattggaactgttcgacggtgacttgcctgtgtatcttctgcatacagacggttcagagactactgtatccgacagaaaacagattacagaacatgacgggatgtgtggtattgaaaaagaggactggatgaatgaacgaaagatccagatgatgcaggaagaacttgcagagagtgattccaacagggaagcacagcttttgtatgggaataccgataaatatggtatttatcagttaaaggatgatccagaactggataaattccgctttactggaacagaaagtttgaaacgtatgggtattaccaaagataattttgatgcagtattgccggaaaattataagctcgtgtatatgggagaactggcagaattgcaggggcagacacaatcggaaacattggaagcaatctatacaaagttcaatattgaccaccccgcagattataaggctcattcgctttccgtcagcgatattgtagtattgcatgaggacggcgagaacagcgcacactttgttgattcttttggatttacagaactgccgaagtttatgctgacattggagggcaaggagaacgaaatacagacagagcttgcggtacatatcgcagatcgctatatccttatgcacgaatgtgatgatggatacgattactccattctgaatgagcagtatcatttactggatggcggtgtatatgacaatccggatattaccattcaaagagcaatggatatggcaattgcagacctgaaagaaccacgcttttcagcggttacagagcagtattatcgtgatgagtatttgcagggtgaagtatatgcgggttcagaggttgagattgtagattacgagaagctttcagaaaaagcggaggaagcggaacgggcagacttggaagcaaagcaggcagaatttagagagaacaatccggatgtggttgcagatttccgggcaaagacagaagaattgtttcatagtctggacggacagagcgcagaggatatagaaaagacggtatatgcttatgtgcagtcgcagattgacgagtacggtctggatgcagaaattgtggatgtggtagtagccgggagccggtgcagaggtattgaaaaggaaaattcggacttggatgtggttgtggaatacaccggttccaccagagaagatgaccttttcaatatgctgcatgaggacagcatttatattgcaggcattcaggtagatattaacccgattacagagggaaaaaccggaacgctggagacatatctgccggaggtggaaacttatctgcaggagaaggcacagcaggaacagatcaacaatcagcttgtcacgcaggggaaagaagtgatgcaggaacaaaacacacttgcatcagaagaaaaagtgctgtctgaactggaaaaagaacctatgattgagccggagacagtccatatcacatttacagttgcggagtgtggagaatttcataatatgggcgaataccatgagggcatcgaaacgattgaggaagcaatgaatctctataatgccattgatccttcccgtatgcatgggattccttcgattggtgtcaatatgcacattgaggggacaggggaagatgagcagttagacattgtaagcggcaagagcattgatgttgatttcctgaattatgcaccggagcttcgtgatactccaaaggtacaggatgcaattaaaaagctgattgtggcatatccggagaaagatgtgattgatgtggagacaaaagagcagaagatacagacgcttgcggcagagcttgaccagttatctcaggacattgatccgtatggttatgccgacaccgtagcagatagagaagcacaggtacttatgattgttgatgatataagaaatggcaacattgaaccgcttcgggattttttgcagactgccatagaggaaggaacagacgaggacagcgaaagacaggcaaaggaattgcttgcaaagctggctgagtataaaccgcttgccaagatcgaggaggttgaggagcagaattataacatgattgatgacaggctcaacaatggcgtggagaaattcaatcgtgaggaagaaaagaaagaacagcaggaaaagccacaggcacgttcttctctaaaagagcggcttgctgccaaacagaaagaagtggcgcagggaaagaataaagatgccaaggaacaggataagactaaaaagacgaacagggaggaaatataggaatatgaatcatccatttacggtagaagaaatcaacttcatgtgtgtttttgggacatcagacagaatgaaaatgatggaagaaatcagacgggtaatgctgcacataaaggacagtgatatggaggatgaaatactcgcatgtctggcatcctagcgcggggtgtcagatttcatttatagggtacgccctaaaactatgcgcttacgaataataaatgtcctgaagaaaaaatagccaacattacatgagcgtcgagaattcttttcgataagctgggttggagaacagttcaacggaagttgttttcgttcttctttctctttacgagttagttccttagctaatttcaatagcatgtatttataagtagatggatattatattataagtaatactaaattgaccgcatagccttatgctcgtaaaataattttgtgattttttattaaataagagtataaatatttggaggaaccaatgaaaaagacaacaaacacttcaccttaccagtttgagggcagaatacctctgtctcaggctattccgcttggactgcagcatgttatggctatgttcatcggaaaccttacacctcttatcattgttatgggagcatgcgggctcacagcggacgctggctttgcggagcttagaactgctctcttacagaatgcaatgattatcgcaggtattgtaacattagtacagatgttttccatcggacctgtcggcggaaaggtacctatcgttatgggaacctcttcgggctttcttggagtattaaataatacagttgcagcgtgtggcggcggagttatagcatatggagctattatgggagcctgccttgtaggaggtatcttcgagggcatactcggagccttcttaaagcctttacgcaagtttttccctgcaatcgttacaggctcagttgttatagcaataggactttcactccttggagtgggaatcaactacttctgcggtggcacaggcaaaaatgattacggctcactgccaaacctttttcttggaatggttgtacttatagtaatcgtgcttcttaagcattttgcaccgtcgcgcagtattttttcatcatctgccatcctttttggtattctggcaggatatgttgtagcaatcattatgacacttaccatgtcacatacaggtgtgactgctgacggtgtcaaatacacatattcatgggtagtaaactttgacgaggttaaaaatgcagcatggatagcagttccaagctttataggctttggaaagctttcagatgtgggaatttccttccatgccaatgcaatcatcccaattggcatcatgtttatcgttactgcaatcgagacagttggcgatatctcagcctgtgtggagggtggaatggacagagaggctacagattcagagctttccggcggtgttatctgtgacggtcttggttcatcatttgcagcgcttttcggagtactgccaaatacctcattctcacagaatgtaggtcttgtttcaatgacaaaggttgtcaatagatttgctatttcaatgggagctatattcctcatcatttgcggcttctgcccaaaaattggagctctcatgtcaatcatgcctcagtcggtgctcggcggagctgcggttatgatgtttgcctctatcctgatttccggaattgagctcatcacaaaggagccaatcggcagccgtgagattacaattatctcagttgcaatcggtttaggctacggacttggcgctacaacaggtgctacatcacacctgccatactatgtacagcttatatttggcggttcaggtatcgtgccttgctcactttgcgctattcttctcaatattattttgccgaagaaatctaagaacgcaccatatatgtgggatatggaagaaaaagatgatgtgaagcgtgtggatgattaacgcttaggattttaaagtcgtccggtgcattaagtacaccggcggctttattatttgtgggaaagtatggaaatatatggaaaaagtgatttcaatagtgggcgcaggtggaaagaccacactcgtccataagcttgcaagggaatatcacaggagaggaaaaggtgtgcttgtcacaacaacaacgcacatgtatgtcgaagctgacactgacctatcctgcgattttttttcgttaagggataaaataataaaagatggatattgcatggcggggcagaaaatatcagaacagtcaaagccaaaaatgtgcggactgccgtatgatttgctggatagactgattaaagacatgccacaggcgttagattatgttataatcgaagcagatggagcaaagcaccattctctcaaatatccggcagcggatgagcctgtcatatatccgctcaccacagatgttatcatagtgcttggcacgtgggaaaagggcaagctgtgtaaagacgttgtgttcagatatgagcttatgcaaaacgagctaggaatggcagaggatgtagtggttgatgactcggttatagacacgctgcgtcaggtctatgtcaaaaagcttcgcgacagcgggtttgaaggacggatttcgacatattacagataaacatggaaataataagttaacagggtaactaattatatgagcaataatcaaataaaaaagaaaaatttgttaatcatatgccgtggtgcaggcgatcttgcgacaggcatcatccacagactgcaccgtgcaggacatcaggtgatagcgcttgagacagactatccggcagccatacggcgtcaggtgtccttttgcgaggcagtgtatgatgggagcgcaactgtagagggtctgacagccagactgcttcctgccttgaatgatgcagagacaatttccgggataaatgacacaccgcaagctcatattgcatcgcaaaagtggaagagctcagctatcgaagctgtgcttgaggccggagaggttccgcttctcatagacccaaccggtgaatcaattgcactttttagaccggatgttgtggtagatgccataatagcaaagaaaaatctgggcaccacaataaatatggcaccgcttgtgataggagtaggtccgggctttacggcaggcaaggacgtgcatctggtgattgagtccatgcgtgggcacaatctggcgcgcatcattaccgatggcatggcacagcccaacacaggggttccgggaaatatcgcaggcttcacaagtgagcgtgtgatacacgctccggcagcaggatatatttatgatgtcagaaaaatcggagatattgtgcaaaagggcgatgagatagcgcggatatatccggataaaggaagctatgacaataaattgtctgaatatgttccggtaaatgctacaattacaggcatcatacgaggtcttatccgtgagggttattatttcaaggaaggcttcaagatagcggatatcgatccacgcgaaggggagctttcaaattgttttacgatctctgacaaggcaaggagtatagcaggcagtgtgcttgaggcggtatcggcatttgagcacggcataagggtttattaaatgtgcagttactaatagataataaattatggtaactgaacagttacaatgaggattaattaattgacgcagcaaaacggattagatatcaataatcaggaacaaaataaagaaaagctcacacattttaatgaggcaggggaagcccacatggtggatgtgcacgcaaaggatgacacataccgcgtggcgaaagcctgcggcacgataaaggtaaatgacgctgtatacagggctgtatctacgggcacggctaaaaagggtgatgtgctgggagtggcaaggattgcaggaatcatgggagcaaagaacaattccatgcttattccgctctgtcaccctattgctatgacaaagtgtgatgttgagtttgagctggatgaaaaaaacagcagtatcatggcaatttgcacgacagcctgtgtgggcaaaaccggtgtagagatggaggccatgacaggggtcagtgtggcgcttcttaccatatatgatatgtgtaaggcgctagaccgtggaatggaaatcgggcagatacatctgcttgaaaaatccggtggaaagagtggacactatacagctgaatagttaaaaatacacatttaatcaaggataacagggtgatgtaatgtatactgtagggattataacgataagtgataaaggcgcagcgggccggcgcgaggataaaagcggcccaaaaataagacagatgcttcccaaagatgagtacgaggtggtttcatataaaatcataccggacgagagaaaacagattgcagacgagcttgtcaggttgagtgatgacatgaaatgcaatctggtgcttacaaccggcggcacaggtttttcacctagggatatcacgccggaagctacaatggatgttgcacagcgcaatgcaccgggtatcgctgaggcactgagagcgtacagcatgagtcttacaccgcgcgccatgcttggcagaggcgtttgcgtcatcaggaaaaacacactgatagttaatctgcccggcagtgtgaaggcagtgtcggagagcatggattttctgatgggaaatatagagcatgggcttgatattttactgcagtatgacagtgagtgcggtcggtgtactaggtgtggtttggaatagttaatatttacagagataataattggagtgtgggattatatgaagcttatgaagacaactgaggcagtcggacaggtgctctgccacgatatcacacagattattcccggcgtgaaaaaggatgcagtttttcgcaaggggcatatcataacaaaagaggacataccggtgctgcttagtgtcggaaaagataccatatatatatgggaaaatgatgagaccatgatgcacgagaatgaggctgcggaggtgctttatcgtatgagcgcatgtggcacaaagaaaattgaagcagacacacaatcaggcgtttcttgcggcactgcgagtaaaatgcatccgtcctccgtaaaggagggcaagatagaggtaatcgcagactgtgatggactgcttaaggtggatagcaaaaagcttgaaaaggtcaactcctttggagagctgatgatagccacaaggcacggcaataccactgtgaaaaagggtgataagctcgctggaacaagaatcataccgcttgtcataaaaaaagataagctaaaggaagcttctaatatatgtgaggatggtccaatccttgatattaagccgtttgtggtcagaaaagcagcaataattacaaccggaaacgaagtgtaccatggcaggatacaggatgcatttacacctgttatagaaaaaaaaatagcagagtttggcgcacagatgatgttttatgaggtgtttgatgatgatgacaaaaaaatcacagacggatgcttacgcgcgatagaagccggagcggaaattgtattctgcacaggtggaatgagcgtggatcctgatgataaaacgccacttgccatcaaaaatacaggtgcacggattgtgtcatacggctcgccggtgctgccgggagccatgtttttgctgtcgtactatgatgcaggtgacaggctggtgccgatatgtgggctgcccggctgtgccatgtacaataagcgcacgatatttgatattgtgttgcctaggcttatggcacgtgatatgatttatgcagatgagcttgccggacttggagaaggcggcctctgcctgaattgtgatgtctgcacgtttcctaactgtggttttggaaagggcttttaacatgcgcgatggatttggcagagagattgactatatgcgcatatcggtgatagatagctgtaatttaaactgctattactgcaatccctgtgacaataatgagcactgtcatgcactaaatatacttagcgtaaaagaggtgctttgcatagtccgcgcagccacaaggcttggaattaagcattttcgtctgacaggcggtgagccgcttttgcatccgcagcttgatgaaatggttttacaaatcaaaaagataccgggtgtcagcagcgtatcgcttactacaaatgcagtactgcttgcgcagcatgcaaagtggttaaaggaagcaggcatagacagcataaatgtgagcctggacactatagatgcgtcagaatatgaacgcatcacaaaaaaaccgctgcttgaagaagtaaagcatggaatcaatgccgctatagagtgcggaataagagtgaaaatcaatgtggtgctcacaccgcagacagatgtggtggcgctcacacggtatgttgcaaaaaaaggtacagatatccgctttatagagatgatgccggtaggtgaaggacacaccaacggagtcgagccatataagaaggttattggtacactttcaaaactgtatggagaaccttgccgtataaatactgaaaaaacaaaagaaattaattcgggaaatgacaaacggaaaattccggataacggcccggcagagtattacatttttccggaacttggtatcagagtaggtctgattcaggcaattcatgggaagttctgcgacacctgcaaccgcatacgtgttacggctgacggcaggcttatgccatgcctgggaagcagcgtgacgatggatttagtacctgattcatgggattttgcagatgatgtggaaaaagattttgcaatagtccgggcactaagggctgccataaaggcaaagccaaggtgtcacaattttaatgataatgcagtgacatatacaaaaactacagagaaaaagactacagagatagaagctgcggaagtaaatgcagcaagaaatatgagccggatagggggctgatagaaaataatgggaaagcttcttgcaatcaatataagcaaagagagaggaactgaaaagagagaggtgccacaggcggagcttgttgcagactacggcatcatgggagatgcacatgccggaaagtggcacaggcaggtcagcctgctttccgcggagaaaatagatgacttcagggcaagaggggcacagatagacaacggtgcattcggtgaaaatttaattatttcaggatttgatttaggaaatctgcctcttggtacacgcttttgcataggagataccatccttgagatgacgcagataggcaagcagtgccattcgcattgtgccatatacaagaggatgggcgagtgcattatgccaaaggagggtgtgtttgcggtagtcgtaagaggtggtcagattcatgccggtgacgaggtgaagttgattccggccaacatatatgcttcgataaaggacagacctgtggacagccgctgtgagcttttgacagtcatagaaggagcacatgccggggcaaaggcactctatatagatggcagaataagagtggcatacggcaatgtgtgggcagatgaaatagatgacaatgataattccattgtgatgttcagacagcagataggcagcagaccacgtctcataatctgcggtggagggcatgtatcggcggcacttgtacgcatggcatcgcttttggcatttgacatatgggtgatagaggacagacctttgtttgcagacaatgcaaagcgccaaggcgcagaccatgtgatttgcggcgattataaagaaactctcgccaagctacagccgcaggcggatgattactatgtatgcatgacaagaggacatcgcttcgatatggaatgcctcacagagatattcacaaagtcctatgcctatgtgggtatgatgggctcaaagaaaagagctgtgatagtgaaaaaagaccttgaagaatcgggattttcacaggaaattatatcaggattacattctccgataggtcttgcaatagggggacagacaccggaggaaattgctctttcggtgataagcgagatagtaaagtgtaaaaatgagcgtacaagctgcactcagatagataacgaagtgcttgacgcacttactgaggtggctgggcattgtgcatcagttacacactccccggatgagaagtacatactgtgtaccatcataaaaaagaacggcagtgcaccgcgcggagttggcacacagatgcttgtgagctcagacaaccgtattgttggaacaataggcggaggctgtgcggaggctttagttataagccgctgcaggaggctgtttcgcaatcaggagttcaaatgtgagctgattgatgtcagcatgaatactgacgatgccgagaatgagggaatggtgtgcggaggcagcatttcagtgctgctggagcagatcaaatgatgaataaataaaaagaaaagagagattaaaagtgtgattttaagaagagcaacaggcactgataaatcagtaaaggagcgcaagggtttaaagagaaaatttgcagcatatgcaggacttacgcttggacttattcttacagcaggactttttgcaggctgcggaaagaaggatactgcagagagcggtaatgctactgataaaattgtgacaagcagcgcgcagacagagaacggtaatgtagatgtagatttatcgatttttgcggcaaagagcttaaacagtgttatggatgaaatttgtgcagcctacaccaaggagcatccaaatgtaaacttccagaacaactatgacagttcgggaactctgatggcacagattaaagagggcgcgaagtgcaatatctttttctcagcaggagtggcacagatggatgagcttcagaatggttatgaagcaggaagcgtggttgatgatactcgtgttgaccttttaaataatcaggtgtgccttgttacatataagaatagtggcacggcagttaccagctttgcagacatctcaaaggctaaaaatatggcacttgctgacggaacagttcctgtaggacagtacaccagagtagcacttgtaaattcaaaaatggttgaaggagatgcttcaaagccacaggatatttcagattctgatatctcaaaggcacttggcggtctggaaatcaatagctgtgcaaatgtaggtgcagttgcatctgccgtagctgagggtgcaaacgaaataggaacagtttattactcagatacattcggatacgagaatcagcttgacattatagaaaagcttccaaacagcttaacaggtgatgttatatatccgatagcagccttaaagggtgacaacactacagcagacgagcttgaagccgcaaaggaatttattgcatatcttcagacagatgaggcaatgtcagtatttgagaaatatcattttacggtaaatgaataatgggaacgattgatttcgcaccgctttggataacattaaaaacaggaatagtagcgtcggttttttcattctttattggaatagcctttgctgagcttgttataaacacaaagggcagagtgagggcattctgggatggactgctgacacttccgatggtattgccgcctaccgtggctggatacatccttttaaggatttttagtacaagacgtccctttggaagttttttaagcaatagcatgggtatacaggtagtacacacgtggcttggctgtgtggttgcagcgaccatcattgcactccctctcatgtacagaaatgcgagagcggcatttgagcagatagacgaaaatgtcatatatgcggcgcgcactctcggcataagtgagtggaaggttttctggaaaatacgtttgccgatggcaaagcccggcatcatatcgggtgtcacactggcctttgccagagctatcggtgagtacggcgctacatcaatgcttgccggaaatatagcgggaaagacatcgaccatatcacagcagatagcaatggtcatccaaagtggtgactatgccacagcgggcttctggtgcatagtaatcatagcgatttcgtttgcatgccttgtatcgataaatatgatatgcggcaaaagcaagggcataaagagaaagagaaaaaataatgtcgctcatagtaaaaataaaaaaacagttggataatttcatgctttcggttgacatggagcttacggacgagattgtgtccgtaattggtatgtcgggctcaggaaagagtatgacactcaagtgtatagcagggatagagactcctgattcaggctttatatcattaaatgaccgggtgctgtatgactcaaaaaatcgcataaatctgcaccccggtaagcgcagggtaggctatctgtttcaggactatgcactttttcctacaatgaccgtgatggaaaatatatgcatagcaatgggacatcgcgatgaaaaaaaggtgaaggtctggctgaagcggtatgggcttgatggcatggcagacacatatccggatcatctctcgggaggccagaggcagcgcgtggcaatgcttcgcatgcttgcggctaaaccggagtgtatactgctcgatgagcctttttcggcactggatgagcatgtgaaaagaagtatggaatcagagcttatggagatgctttccgattttcacaatcctgttatctttgtgtcacacaatcgcgatgaggtgtatcgtctggcagagcgtatcggaagtattgagagcggcatgctgagtgcagtccgcgacaaaaaagatttcttcatgcggcctatgtctgtggagcaggcactgcttgtgggctgcaacaatatatcacaggtgaaatggcaggataagcatcatgttcttgccgtggaatgggatagcgtatttgaggtcactgatgagcagattgaacagcttgcgatggatacggacaacatatcacacataggtgttttccctcaggatataataatatctgcaagtaaagcaaaatcggtacttgcatataacaataaaaatataatcaggattaaagattataaaatagttgaagaactaaaaacatgggaagtatcgtgtgaattaaataatgattcaacaatttatgcaaatcttccaaagcatacagaagcaaatatgcttagcaaaaatataaatgatgagctttatataaagaaattttatctgcttggatgagaagtaaatgaggacatactatgatttacctggacaacgctgccacaacaattaaaaagccggatgcggtatatgatgctgtgcttgatgcaatgaagcactgcggcaattcaggtcggggaatgtcggatgcatcgcttgatgcgtcaaggaaaatatatgaggccagaatgtgccttacagaatttttcggcggggaggatgcggatagacttgtttttacggcaaattccactgagtcgctcaacattgcaatccacggactgcttgagccgggggagcatgtgattacgacacagctcgagcacaattcggtgctcagacctctttatatgcaaagggagaggggagtgtgcgtggatattgtgccatgcagtgatgaaggaataaaaagagggataatttccccgcgggatatagaggctgcaatttgtccggaaacaaaagccatcgtctgcacacatgcttcaaatctcacaggcaatgtggtggatattaagtcaatagggcaaatcgcacgaaagcatgaccttttatttatagttgacgcatcgcagacagccggtgtgcttccgataaatgtaaaagacatgaatattgatgtgctctgcttcacagggcacaaggggctgatgggtccacaggggaccggaggactttatgtgggagaaagagcagatataaagccggttaaaagcggtggcaccggcgtgctcagctttcttgagagccagcctatggagcttccgacaagacttgaggccggtaccttaaatggcccgggaattgcagggcttttggcaggaataaaggcgattgaagaaattggtgtggataacatatatgctaaagagtatatgctgatgaaggcttttctaaagaaaataaagataattccggaaatcaggatatatggggatttcgacatgctgcccgataatggagcacattgtgcgattgtttcagtaaatatagctgatatggattctgctgaggtgtcggatatacttatgaatgagtatggcattgcaacaagaagcggcatacactgcgcaccactgatgcataaattctttggaacacaaaaacagggtatggtgagattttcattttcatattataatacaaatgatgagataaatgaggccgctgaagcgcttatgcagattgcggcattgagataaacagtattaaacaattgaaaggagcaaacatgccacaggaaatagtgttttgcaaaggcggtggctgtactgcaaagcttggtccggatttattaagtcatgttttagcaaagttgccaaagggcgaaaaagacagcaatctgctcgtcggatatgatagcagcgatgatgcggcagtgtacagaatttcagatgacacggcgatagtccagacgcttgatttttttccaccgatggttgatgatccatatacgtttggacagatagcggccgcaaatgcgctcagtgatatctatgcgatgggcggcacagttaagagtgcgttgaacatcgtttgtttccctgagaaaatggatttgaatatactcggtaaaataatgcagggaggcgctgacaaggtgatagaggcaggcggtacacttgcaggtggtcattccatagcagacagcgatgtgaaatacggactttctgtcatgggcacagttcatcccaaacacatctacagcaacaatacagggcagccgtcagatgtgcttatactgaccaagaagctcggagttgggcttgtgtgcaacgcaaaccgtgtcggggaagctccgttaggtgcaattgaggatgcggtaagctccatgaccacactaaaccgcgcggcatcagagatcagtcacagcttcgaaatacatgcatgtacagatgtcacgggctttagttttttaggacatctgagcgagatgttaaatgatgatataacagcacttatcgactcgatttccatcccggtcattaccggagcactgcgatgcgcagatgagtttttcctcacggcagcggcgcagcgcaacagaaaccatgtaggtgacaaggtgcgttttgcaaaaaatatacctttctcaatggaggaggtgctcttcgatccgcagacctcaggaggactgctgtttgcagtaaaagcctttgaggcagatacctttttgcatgagcttaaagccacagggcttccggctgcaaaggtgggacgatttgttaagcgctgcgatgtgccgatatatgtgaactgattttaagctatcatagcttatgtaaatatgctgacaggctgcatgtcctgcattttgaggattgacaagttaaataacatagggaggattataaatatgattacagtaaatgcaatcggggatacatgtccaatcccggtagtaaagacaaagaaggcaattgaggctctcacacagccggacacagtggagacacttgtggacaatgaaattgcagtagaaaatttaaaaaagatggctgcacagaagggctatagctgcgacagcaataagctcgacgacggaagctacagtgtaaagctgacaattgagactcttaacacaggagcgttttcggatacagacgaagcttcacagtacacatgcaggccggctacagataacagagtcgttgtaatccgctcttcctatatgggagagggcagcgaggagctgggcagtgtactcataaagggcttcatctatgcactttcgcagcaggacaatccgcctgaaaccatgcttttctacaatggaggagcaaagctgacctgtgatggctcagagtgccttgaggatttaaaggagcttaagaatcgtggcgtgaaaatctttacctgcggaacatgtctgaattactatgagctgtcagataagcttgcagtcggagaggtgacgaacatgtatgatatcgccgagaaaatggctgcagcctctcttattgtgagtccttagtgttatattaagtgtgatgtgatggataataatttggtaagagaaaagaaaaagcggctaatcattaccttcgagactaccacagcgccgttaaagctggatatcaagggcaaggcatgtggtattccggggcgcacgattcctcttccgtctgctatatcggcgggctgtggtctggcatggcgtgcagagctttcagacagggagagcctcatagcctttatgaaggagcaggacattaggtgggaagccatgtatgagcttgaaatgtattgatataggagaaaaatatgttttattacaatcagtatgtgagggcgcaaagccttgatgaagcctatgagctttatcagaaaaaaccgaattttgtgctgggcggcatgctctggctcaaaatgaaaaataagacacttggcacggcaattgatttgtgcgatctcggacttgaccggattgatgaggatgaaaacgagtttagaatcggtgcatatgcaaccctcaggcagatagagacacatgaagccctgaatgcatatacacacggtgcaatcgcagagtcggtcagacatatcgtcggagtgcagtttagaaatgtggcgactgtcggaggaagcatctggggcagatttggattttcagatgtcatgacgattttcagggcgctgggagcaaaggtgcagcttcacaaggcaggaattatggatttggacgagtttgcggcacttccaagaaccacgcgcgatgtgctcgtatcagtaatagtgccgaaaaatgcaaagggcgtagtatacttaagccagagaaaccagtcaacagactttcctgtgctcacatgtgcagtggcaaatagaaacggcaggtatgtggcggtcatcggagcatcaccatatatggcagagcctgtgtgggataaggacggcatactcgatggtatagtagatgcaaagacgcacggtaatgtagctttgacggagaactccgagaacaatgcaaaaatagataaatttgcagaatatgttgcagagcatatccgttttggaagcaatatcagagcaggagccgagtacagagagatgatctgccgggtgcttacacgccgcgctgtcacacagtcgcttgacatctgcgatgatataaggtaatcgctaccggatgcatggaagttatgcaggaaactttggaagctttattagtgtgatgacatcaatgcacgagcattaagtaggaaggaattcatgtatatggatgttaaaataaaattaaatggaaagttaataatcgactcggttgaccaggatatggtgcttttggacttctgccgcaagcacaactgcttttcagtgaagaggggctgtgagtcaggcaactgcggtctttgtacagtgcttctggatggaaagcctgtgctgtcatgcagcatgccgataggcagggcagacggcagagccgtggatacccttgagggacttgaggaggaagctaagcagtttacaggattttttgctgcacagggagcggatcagtgcggcttctgtaatccaggttatattgtaaatattgtggcacttttaagagaaaatcctgacccgactgatgaggaagttcttgagtatctttcaggaaatctgtgtcgttgtacaggatatcagagtcagctccgctcaatcagaaatttcttaaacagtaagaaggagggcgcacctcttaatctcgaggcaggcgtctacggagaggatatcggaaaggagtggcaggatgagcacaaatcaaactaatgtaaacagcttcaaccgcgcgagaagggattaccacgcagttggaaaatgtataccgaagaaggattcgagccagcttttactcggaaagccggtatttactgatgatatcacaccgcgtgatgcgcttgtcataaagcttcttagaagcccctatgcgaatgcaattgtcgaggatgtaaagacagatattgctcttaaggtaccgggcatggtcgcagtatacacctgggaggatgttccgaaaaagcgtttttctatcgcaggccagacctttccggagccgtcaccgtacgacagactaatccttgaccgtcatgttagaagtgtaggtgacgctgtcgctattgtggtaggtgaatcggaaaaggctgtagacaaggctcttaacatgataaaagtaaagtacacgattcttgagccggtgcttgacttcagaaagtcgctggacaacaaggtgcttgtgcatcctgaggatgactggtcatccagcataaatacaggcgatgtaaagcgcaatctcattcatcatgaggaggatgagcatggaaatgtagagaaaattctgtcggagtgcgatgagattattgagcacacctatcgcataaaggcagcgcagcaggcatatatggagacctgcagagcatactgtgagatagacagatacggcaggcttcactgcatcagctcgacacagattgttttccacctgcgccgaatactgtccaatgcactcgatattcctaagtccatggtgcgtgctgaaaagccgcgtatcggaggaggctttggtgccaagcagacagcggtctgtgaggtatatccggcatttgttacctggaagacaaagcgtccgagcaagataatctacagcagaaaagagtgccagactatcgcgtcaccgcgtcatgagatggaggtcaccgtgcgtcttggagcaatgagggatggtcatataagggcgatagatctttatacgctgtcaaatggtggagcatacggagagcatagcactacaacagtaggactctcaggtcataaatcgctccctctttatacaggaggctgcgaggcaaccagattttcgtgcgatgttgtgtacacaaacgtgcaggcggcaggagcatatagaggctatggagctacacagggtatctttgcacttgaatcaactgtcaatgagctcgctgaaaagctgcatatagacccggttgagcttcgtttgaaaaatatcgtccgtgagggcatgtttatgccggcatattttggcgagacagccaatgcatgtgcactcgacagatgcataatgcactgtgcggataatttccattgggcagacaagtatcctgtccgcgatatgggaaatggcaaggttcgtgcggcaggcatggcacttgcaatgcagggctcctgcatatcaaatgtagatgtcggatcgtgtaccttaaagctttcagactgtggcacctacaatatgatgataggcgcggcagacatgggaacaggctgtgataccatacttgcgcagatggcggctgaggtactcgactgcgagccggatgatataaccgtgtttggagcggatacggatgcttctccttatgattcaggttcatatgcctcatcaaccacctacattacaggaatggccacacagaatgcagcacttgagcttcgtgaaaacataaagaaaatcggtgcacagatgctgggccatgctgcatcagaggtggattttgacggcaaagaggtgtatatcataaatccggacggtgcagacaatggggaggtttgcgtaagtctttccgatatagcaacaaaatcacaggtcaacaacacgatacctgtagatgtcacagcgacatattcatcacctgtttcacctcctccatacatggtaggaatggtcgagatagagcttgataaggagacaggagcagttaaaatacttgattatcaggctgttgtggactgcggaattccggtcaatccaaacctcgcgcgtgtacagaccgagggcggcataggtcagggaataggcatggcgctttatgagaatgtcacctacaatgccggtggaaaaatcgcagaaaatgacctcatgcagtacaagataccgacacgacaggatgtgggcaatatcaatgtcgaatttgagacaagctatgagccgtcaggcccattcggagttaagtcaatcggtgagatagttatcaatacaccggctcctgcgctggcacatgccatttatcgcgcaacaggcgtatggcacaggacagttccgtttacccctgaaaaaatacttatgggaatggtagacccaaactggcacgaaaaggaccttagagtgaaatgattcatatcatatacatggcggctggaaacagccgccgttttggaagtaacaaactgttttatgagctggatggaaaacctatgtacaggcatttgcttgatcgcttgacggaaattaaaaatagatataataaatcaaaatcagacagccagaccatagatataacagttgtcacccgttaccgggaaatattggactactgcgcatgtatcccagattgccatgcagtcataagtccggacagcgaaaaaggcatatcctacactataaaggcaggaattatggcggtgcaggagcagaaaaagcttaagaaaagcagtgaagtgacgcatcatactgccgaaaaagaggaatattacatgtttgcagtagctgaccagccatatttaaaaagtcaaagcgtgattaaattaatagacagagtgcttaaaaatacagggggtaagcgattggcgttttcacttcgttgtggagatgctgtaggcaacccgtgtgtatttaattcatcgcttataccacagcttttatcactggagggtgataagggtggcagaagtgtggcaaagaagcatgactgtgtatatgtagatattgcagatgagagagagctgatggatatagatacatatttaatccgctaatttactgcctttaagcagtaaattgctactttctcagtgtagtgcgggtcaataagacatacatcgaattgcatgcaagcatgcatagatgatgtcctttcccccttgaattatacatatttcatacagatttccatatactacctccaaagcatgaatgcaaatgcaaaagtaacggaggacaataaagtgaaaattacaggattgaccagaagagtagactcactcggcagaatagtcatatcgaaggaactgcgcaggatgctccatatcaaggagggcagcccgctggaaatatatatggatgcagacgagacgatagtgctaaggaaatattcgcaggtgggaagcctcaaaaatatatcacaggcatatgcacagagcctgtcaaaggtaactggtgccacggtatgtgtggcagacagggatgagataatagcggcagccgttatactttgtgcttacgctgaacaaggcgataagcttgagattgtcgaaaagctggtgagtgcagcagcagaatttccggccagacagcttggctagagacagcgaaaagctggtgcacaaaaggacaagctaaaaaaatatgcagattatcaggaaatgtctatcgtcggggaatattcggatgagggtaaatcgggtaagagtgtggaaggcagaccacagtttaaacagatgttatcggatatagaaaatggtaaagatgatgttgattatgtgttagtatttaaactgtcaagatttggaagaaatgcagcggatgttttatcatcattgcagaaaatgcaggattatggagttaatcttatctgtgtagaggatggaattgacagttctaaagatgctggaaagttgatgatatctgtattatctgcggttgcagagatagaacgtgagaatatccttgtccagacaatggaaggcagaaaacagaaggcaagagaaggtaaatggaatggaggctttgctccatatggttatcagctggtaaatggtgaacttatcattgcagaagatgaaggcgagattatccgtattatatatgataaattcgtcaatacaacgatgggaatggctgcgatagctacatttcttaacaacagtggttataagaaaaagcttcgccagaataacacaattgaaggtttttctacatcattcgtcaaaggtgtgctggacaatccgatatattgcggtaagcttgcatttggaagaagaaaaaatgagaagattccgggaacaaggaatgaatatcatatcgtaaaacaaaaggaatacatgttaagtgatggaatccatgaggcaatcatatcagaagaaatgtggaatcaggcacatagaaagcgtcaggagacaggtgttttacaggtaaaaacgcacagccttgaacatgagcatattttatctggaattatcaaatgtcctgtctgtggaagcggtatgtatggcaatgtaaaccgcaagaagcatccggatggaggttattacaaggattatttctattatgcatgcaagcatagaaaactggttgacggtcaccgctgtacctataagagacagtggaatgaagacaagatcaatgcggcggtagaggagataatccgtaaatttgttacgaatccaaagttcgaggaagaaatccgaaagcaaataggaggtagtattgatacgtcggagcttgacagagaatatgatggtttaaaagacaaattgagccagacaacaggggcaaagaataagcttgcagaccagatggaccatttatctgtatctgataagaattatgataaaaagtacaatgacatgcaggaacgacttgataagctgtatgatgaaatcaccgatattgagaatgccatagaagaagtcgaaacaagactttataatatcaggcaggacaaaatctcagaagataatgtttaccagttccttttattctttgataagctgtatgataaatttacagatctggaaaagaagacatttttgaagagctttctgtccgatgtatttatctatgaggaagagcaaaaggatggcagaatattaaaaggtctccggtttaaatttccgatatatatgaatggcagaaatgtattgggtgtggatcgggacaacgaaagtacagatgagactgtggtagcactacaccatcaaaggccgactgtaggatcccaaaacaatccaatatccggcgggcaataggtgaacacgaaaaatgcaaccgtaagcaacagcaggacagcggctgcggctttcgtcgacagaagagaagacttgcgataccgtttgttttcgacaaacaatgacagaagaacccctgcaaaatacaaagcgatatttaaagcatcgtagtttcggccaagcacaccctgcagcgtataaaatccgaccacaatcccgcccattccggcgaggataccgagaactcttgccgggagaaactgttccggaagcatattgccgcggagcagcacttcgaggatggtcagaagcagaaacgggaaaaacaaaagttttaaatgctcccaggtggactcatttacagctgagaataacccgacgacagcgttatctctggaccattcataggtgaaatggagaagaacacccagtacagaaataaaaataaaacggaacagattggtttttaaagacatagattcctcacggttttataattgttagaaacagtatatgaaatttgaacagctttatgcaggcatcagccgttttttgtgaaaatatggaaaattcttacgtttttcttaacccatttgaaaccgaaagcataccatggtaaaacaggggtagcaaaaaagaagcttggaaccgatactaccggagcacggattgcagatggtaaagtatattatgcgacctatccggaaggtggaacacacatgaataagatgaatgtgtatcgctgtgaccggaacggaaagaataataaactgttattcacacagaatgttgatgacgaaaatgactatattattccggaagaatttactgcaaagaagataacatttgcagtaagttcagagaaactgtccggttccgaagaagatccggtaatagaatatgtttatgactgcaccacagagcagatcacaaaagtggaaaaatagttactgttcgcagggagacctgcgaacagtaacagaaaataaatgatcatattacataatgatacataaagataaagtgacagacacttccacccatcacgaacagatggaaaatttcatggctgccgaagtatttgtgaagtgcgttaaataccggaagtttcagagcatagattacaccaccgatggtgtagatgatgccgcctgccaaaagccagccaaacgcggcatgcgggagatccgtccacagctgggtaaatactggcaggcacgtccagcccatggcaatgtaaatgatggaagaaaaccatttcggacaggtgatccagagtcctttgataatgattcctgccactgcaattccccatacaagagccagaagggtatatccaattctgccgcctaagatgatcatgcagacaggggtataagatccggcaatcagaacgaagatcatcatatgatcaagcttctgaaaattccggagtaccttagcagatacatgacagatactgtgatagattgtgcttgctgcgtacaataaaaccatgcttgtggcaaaaatggtcatagcaagcatataggttgtatttccatgggcttttattaaaagtggtgaggctgcgatcaaagccatcaggcaaccgataaaatgtgtgatggcgcttccgggttcccgaattgttaattgcatggtaaaatctcctttcttacaatgtgtaaataaaaactaactaatgtagtattgaaaactatatctaacataaataaatactatgatatattggtgcgcatgtcaataataattatgcataaaaaaacgggaataaaatgccgtttcattgacacaagttcaatgtttgtgtattatgcagttagttaaaactaactgcgtgaatagtatgaaaagaaaggatttctgatgtatgaataaaaataacaggaaagaaaaaaaagacaatttaaatattttgaagtttatcggccccggactgctggtaacagtcgggtttattgatccgggaaactgggcatccaatattgcagccggatcgggatatggatataccctgctctggatggtaactctttcaacgattatgctgattattttacagcacaatgcagcgcatctggggattgtgaccggattgtgtctgtctgaggcagcaagccgttacataaacaggacattgaagaatgtgattcttgtaacggcagtagccgctgccattgcgactgcgatggcagagattttaggaggtgccattgcactgcagatgctgttccacattccgattaaagtgggcagcatgctgatccttgtcgtggtcttgttctgtgaatttaccaatgcatataaaaggatcgaaaaactgatcatgctttttgtctctctgattggtttttgctttttaattgaaatctgtatggtgaaaattgactggggagctgccgccacaggatgggtaaaaccggtatttccatcgcatgcgatgccggttatcatgagcgtgcttggcgcggttgtcatgccgcacaatctgtttttacattcggagatcattcagagccggaagtggaatctgaaagaagaagcggtgattcagagacaattgaaatttgaatttaaggatacgctgttttccatgatcatcggatgggcgattaacagcgccatgattctcatggcggcggcgacgttttatcagaaaggggaaaaccaggtggatgatctgacgactgcgggaaatatgctgacaccactgcttggaaatgaagcaacggtgatttttgccattgcccttttacttgccgggctttcttcaagtattaccgcagggatggcgggaggaacgattttttccggaatttttaataaaccttatgatattgcgacgaaagaaaccagacagggtgttttgattacgatgattccggcagcgcttatcattctgctgatcgggtctccgtttcagggattgatttattcccagatgcttcttgcagtacagcttccgatcactatttttacgcagatttatcttacctcgtccaaaaaagtgatgggaaagtatgcaaacagtaccggacttaaaatggttctctgggcaattgcaattgtagtcacagcattaaatatcgggctttttgtgacgggcttttaaaaagatgatagtttttttagaaattctctgggcgtcatgtggaatttccgtttaaaaactttatgaaaataggaaaggttgtggaatcctgtggcaagagagacctccagaatggaggtgtttccctgttcaaacagttctacagccttttccaatcgaagattgttgaggtattccactacggtcatgttcatgtgttttttgaaaaaacgcataaagtaatattcgctgaaatagcactgggcagcgagaccggcaaccgtaagcggctcggcatagtgcagatggatatagtccagtacggtttttaatttttcagaggcgtttgcggtgtcgacagatcgtttcccgtccggggtacggttctgcaggagcaggaaaataacctgcagcagtaatgccttaatggccagttcgtatccctcaaccggatttgcaaagagagagctgatctgtgcaaaaattttgcgcagagatacataagccggatgggtcggacggatcagacagggaaccgacagttcttcattggtcagtggcatcagataacgggtggagcagatatcggtcgcatttccaccgagaaagttcatgtgaaacacataggtttcggactggtaaagcgcagactgtccgcgggagaccgagtgcagcagcagaggcgggataaaaatcagatcgtctttttccacagcgtaggaagtaaggtcgatctggtagctggcatctccttcggtgatgagtgtaaattcagcctcttcgtgccaatgcgttgttatgaccggataatccggctttaaagaagtgatatatttctgtatggggaaggtcgcgtcaccgtgacgggcatcttctttctgttcaagggcaagtgtctgtaaccgtttcatggaaaattctcctttgtcttatgagagcagtattgtgttataaaaagtaagaattatgcaagataattttgaaattccaaactataatgacagtataatgttacagaaacaaattgtcaaaggacatggagatacaggcgaaggaggacatggacatgcagaaaaaatggtggcatgacaaggtggcatatcagatttatccaaagagtttttgcgatacaaacggagatgggatcggtgacctgcggggcattatttccaaactggactatttaaaggagctgggagttgacattatctggctttctccaatctataagtccccgtttgtggatcagggctatgatatttcggactattatgcaatcgctgaagaattcggaacgatggaggaattcgacgaactgcttgcggaggccaaaaagagagatatgtatctgattatggatctggttgtcaatcactgctccgacaagcatgaatggtttcagaaagcactggcggatccggacggaccgtatgccgattatttttatttccggaagggaaaaaatggaaatccaccgagcaattaccgttcttatttcgggggaaactgctgggagccggtaccgggatcggacaaatattatttccatatgttcgcaaaggagcagccggatttaaactgggaaaatccaaaactgagggaagaaatctaccggatgatcaactggtggctggacaaaggactggcaggttttcggattgatgcgatcatcaatattaaaaaagatctggcatttccggatatggagccggatggtgacgatggactggcaagctgttggcgtatggtcgaaaatgtagaaggtgtcgatgcgctgcttgaagatttaaagaatcatacatttgccaaaaaggatgcatttacggtaggggaagtatttaacattggggtggaagacctgccggactttattggagaaaatggacatttttctacaatttttgatttcagcgcccatatgctcagtgacggggaacacggatggtacgatgcgccaccaatttcttttgatgcgtggaaaaaagcaatcacagattcccagatgcgggtacagaatgtcgggttcgaggcaaatatcattgaaaatcacgatgagccgcgcggcgtttcccgttttctgccggattatgcgcaaaatgcggacggggcaaagatgcttggtacagtaagtgttctgctgcgtggaattccgtttatttatcaggggcaggagattggcatgcagaatgccagatggaacagtgtggatgaattcgatgatatcagtaccaaagaccagtacaggatggcgcgtgaggccggactttcggatgcagaagcacttgccgtatgttcggtcatgagcagggacaatgcacggacgccgatgcagtggaaggatgcgccgcaggcgggctttacctcgggaactccatggctgaaagtcaatgataattatccggtgatcaatgtggaaaaagaggaagagcagccggattcggttctgcattattacagaaaacttatcgcattgcgcaaatctgaggaatatcgggagttgtttacttatggaaaatttgagccggcatatgagaatgcagatcacgtaatggcatattaccgcatcctgcaggggcgccgggttctggtagcggcaaattttggaacagataccatagaactggattgggaagttccggcaaaaaaggtacttttatcaaataaaaaacgaacaaatgctgaaaataagctgattttagagaaatgtgaagtgtttgtgacggaatgtaaatagcgttgcaatcttatcggattttgatataatgagagcatacacgaatgtctgtttggggagaggaaaggtatgccgcagtatatcgcaattgatctgaaatcattttatgcatccgtagaatgtgtggagcgtggacttgatccgctgaccaccaatctggtggtggcggatgaaagccgcacggaaaaaaccatctgcttggcagtttctccatccctgaaaaaatatgggattccgggaagggccaggctttttgaagtggttcagaaagtaaaacaggtaaaccgcagccgaaaaaccggtgagccggaattgtcgtacattgcggcacctccgcggatggcactttatgtggaatacagtacgcggatctatgatatatatctgaaatatgtggcgccggaagatattcatgtatattcgattgatgaagtgtttatggacgtgacacattatctgaaaacctatggaatgacagcttatcagctggcgcagactatcattctggatgtgcaggatcacattgggatcacggccactgccgggatcggaaccaacttgtatctgtgcaaaatcgcaatggatattgtggcaaagcacatcgatgcggatgaaaacggtgtgcgcattgcccagctggatgaaaaaagttaccgtaaactgctttgggactaccggccgatcacggatttctggcgtgtcggaccgggatatgcgaagaaactggcagaaaacggaatgtataccatgggagatgtggcgcgctgctccatcggaaaagaaacagattattataatgaagatctgctttacaaactgtttggtgtgaatgcagaacttttgattgatcatgcctgggggtacgaaccgtgcacgattgcacagatcaaagcgtatcgtccgcaggcgaacagttccggatcgggacaggtattgcagtgtccgtacccggcagataaagcaaggattgttgtgcaggaaatgacagaccagctggtactagatctggtggagcatggattcgtgacggatcagatagtgctgacggttggctatgatatcgaaaatctgacagacccggtgcgggcaaaaagatatcacggggaagtgactacggatcgttacggaagaaagattccaaagcatgcgcatgggacggcaaatttgcaaaatcatacatcttctgccattacggtagtagaaaaaacactggaattatatgacagaattataaatccggatcttttgatccgcaggatctatgttacggcatgccatgtacgcacagagcaggaggcacaaaaagaacagacttatgagcagatgagcctgtttgattttgcggaagaaaccgaggaacagaaggcacaaaagcaggcattgcagaaggaaaaacagatgcagaaagccatgctttccattaagcagcgttatgggaaaaatgccattttaaaaggaaccaatttcaaagaaggggcaaccatgcggcagcgcaacggacagattggaggacatcgggcatgaaccggctggaaaatacgcatcgttatgatgacatcatagatctgccgcatccggtttcgaaaaagcatccgcagatgccatcggaagaccgggccgcacagttttctccgtttgcagcattgaccggttatgaacgcgccattcgggaaaaagaaatgcaacatgaggaacggatgatgctcggggagggcatcagcagggaaacttatgattcagaataaggacaacatattttttatgattaaattcatacgatatactaagcaggaaatttgtgtggtatgaaatggcagacaaaaaacaatggaaaagatatgtggggtatgcactgtttcttttcctgtcatacagcattggaaacgcagcggctgttgtaagtacaatgacactgcagccggagaaagtggagaaagaaatgaaaacagttgcaattacctttgatgacgggccgaatccggaatatacaccgaaattgctggacggattagaaaaacgtggtgtaaaagccactttttttctgctgggagaagaggtaaaacagtatccggatgtcgtcagacggatgcatgatgacggacatctgatcggtgttcattcttataaacatgttaattttaaggaagtgggcacggcatgcactttgcagcagattgaaaaaacacagaaggcgatttatgatgtgacgggagaatatgcaggatatatccgtccaccttacggatgctggcagaaggaactggatgcgcaggtaaatctgatcgaagtactgtggaatgtagatccgcgggactgggcaacgaccgatgcggatactgtggttcagagagttctaaaggatactaagccgggggacattattctgcttcacgatgcttcggcgtcatctgtacaggcggcatttacggtcatagataccttgcagaaacagggatattcgtttgtcacggtcgaggagcttttgttagagtagcatacttgaatgttccggtgatctcgtggtaaaataactagcagacccaatcattacaagctgaaaaagaaggaataaaaaatgagtaacgataaatttgacacggcacggcaggtgcttcgtcagcagaaattaacaggagaacgcgcactgtttcagtctgaaaatctggcggtatatgacagtgtgtttgaggatggggaatccccgttgaaggagagcagcagtctttatctggataattgtctgttccggtggaaatatccgctctggtattgcaaacatgtcgatgtaaaggaatgtacctggtttgacatggcgcgggccggggtatggtataccgatgatatttcggtaagagattccattgtagaagcaccaaaaaatttccgccgttgcaggggagtaaccctgaccaatgtaaatttcccgaatgcagaggaaaccctctggaactgtaccgatgtaaacctgtcctatgtgcaggcacatggggattattttgccatgaattgtaaaaatatgcagctggatcattttgaactggttggaaattattcatttgatggtgtggaaaacatggagatccatcatgcacgcatgctttccaaagatgcattctggaacagcaatcatgttactgtgtatgacagttttatttcgggagaatatctgggatggaatgccagaaatcttacacttgtcaactgtacgattgagagcctgcagggcatgtgttatatagaaaatctgaaaatggtgaactgtaaattgattaatacgacactggcatttgagtattccacggtggatgcacagattgtaaataccgtggacagtgtgctcaatccttccggcggaatcatccgggcggataagattggaaaactgattttggaaaaagacaaggtagatccagggaaaaccacaattatatgtacagaagatgaaggggagggacaacgatcatgaaagcaagtcacagaaaagacgtcattattgccagaattatttttgccataatctgcgcagcactgctcgcaggaattatatcacttatcgtatggcttcatgggcggaatgcagggaaaaaccagacaccggaaacggaaatcacaaataatgcaccgccggcagacaacagcaatctgccaccggtaacagaacagccgttggacgaagacggacagagtgtatggacaagcacggatggcgtaaatttccgtgcagagccgaatacagacagtgaaattcttaccgttctcgtgacgggaacgaagctgacactgctgggagaagaaaacggatgggtgcaggcagaatataacggacaaaaaggatatgtcagttcagactatgttaccgatcaggaaccggatacaacaacgcaggaaacagagtaacggaaaggggaaacaatgagtacagcaggaaaaattatgtccttccgacaggatggaaatgagatttgtgtgaagtatgaacagcaaaaactggtggtgaaagccataagggatgatattgtcaatatttttgtgccttacagaacaaaggaacattattctaaggccattgatggagacaaggcggttgcgacagaactgacggcagagcaaaaaggagaagatctggtaattgcaaccgataagatccggatgcagtttggagaaaatctggaaatggtgattacgagaccggacgggactccgcttgtccggacacaccggcagggcagaagtgtttgtggggaagtcagtgagcagatgaaacagattctggagtcggaagggcatgatacgtcgaatctgggcgcacatgattatccggtacagatgatgtttgatctggacgagggggatgatttttacggtctgggtgataagaccggattcctgaataaaaaaaattatgagtatgagaactggaattccgatattccacaggcacacaatgaggactatcatgcgctgtacaagtcgattccggtgctcttttgcaagaaaaagaatgacgtatatggcatgttttttgataatacgttccacagctatctcaatctgggcaaagaaaatccagaatattatttttacggcgcggatgatggcaatctggatctgtacttcctgggtggagaaaaactgacggatctgattgaagaatatacatatctgaccgggcggacaccgctgccgcagcgatggacgcttggataccagcagagccgctggggctatcagtgcgcagaagatatccgtgatgtggcagaacatttccgtgatctggatattccgtgtgatgccattcattttgacattgattatatggatgggtatcgtgtgtttacatggaatgatgcaaagtacggaaaacctggggatctgattgcggaaataaaaaaacagggctttaaaacggtaacgatcattgatccgggaaccaaagtcgatccggactattttatgtgtaaagaaggcgaagagaacggatattttgcgaccgatacacagggaactacctatgtcaatgaggtttggccgggagatgcaaattatccggattttggacgccgcaaagtacgcgactggtggggaaaacaccataagtttctggtcgacatcggtgtggacggtgtatggaatgatatgaatgagccggcaagtttccgtggcgggctgccgcaggatgttgtatttcatgatgaggagcgtacgacaaatcatgcggaaatgcacaatgtatatggacattatatgagccgtgcgacctttgagggactgcagaaactttccgataagcgtccgtttgttatcacacgtgcagcgtatgcaggaacacagaaatatgcgaccgtgtggaccggagataatcagagtctgtggtcgcatctgcagatgatggtgccgcagctgtgtaatctcggtatgagcggatttgcgtttgccggaaccgacattggcggattcggtgcggatacgaccccggaacttctgacccggtggattgaggctgccgtattttctccgctgtttcgaaatcattcctgtcagggaacacgcagacaggagccgtggcagtttgatgatcaggtggtgggaatctatcgaaaatatgtaaagatgcgttatcgtttccttccgtatctgtatgatctgttttatcagggagaacagaccggacttccggttatgcgtcctctggttctgcattatccaaaggacccggaaacctataacctcaatggagagttcctggtaggggaaaatctcctcgttgccccggtattggagcagggagccacgaagaaaatggtgtatctgccggaaggggagtggtatgattactggaccggagagaaaattaccggaggaaagtatttcctgcgggatgcaccgattgatttgtgcccgatgtacctgaaagaaggaacgatgatcccgatgtatgaaaaaatggcgtatgttggagaaaagccgtaccgtacgctgtatctgctgacaactccgggagaggcttcttacgatcattttcaggataatggagaggactatgcctaccgtaagggtgtgtataatttatatcatttccataagaatgcacagggagtactggaaacggaaatgcggcacaaaaattatccggaatacgagcagatatgcttaaaaatagtaggaaaataagaacaaaaaaccgttgcatggcatagtctataatgatgacaggatggagcatgcaagtggattattcaaacgatttttacccaaagattccgttttatatgacatatccgatgcagagtatgtatctgacagagatggaatatgaaaaagatatggaacgaatgaaacagtactatccggcagagacaaaagagatcatggagctggtggaacagaggcttgaccagctggaatatgagggaagccgcatctacgatgaggaaccggaccgcctgatgatacagatggagattgatggaatttaccggaagctgtccgaagtgcagaaaaagaaagagaaccggatcgaaggaaacatgcaggcggcatcatatttcgaaatggttccggcttctatcgccggagaaactatgacaacacaggaacgggaatgtgggaatccgtggcttcgcagtatgatcggtgtgctgtttggtgcggaaatgtgcaaacggcgctgccggcatcgcagatgcaggagatggatgtaacggcagaaattacagccatagttaagaaggaaaagataaatgaacaggaaagtaattaaaccagtggtgctgtcagggctttttctggcagcactgattgttttcagtatcataaccaatcaggataataaagatatgacaacggcgatgaaggaggcaacccttcccatcgtccagttttatgaaggaaataacagcgtggcacagctgcacggatacgtatcggaaatgaatattacaaagatgcgggatggaattgtgccggtagaccatacacgactgcttccgctgaaaattaatacatatggacaaaaaatcagaggcattgcttatgaaatccggagtcttgatgattcccggctggttgcaaagggggatgcacaggggatcaaagaaaaaaataatgaaatctctgcaaacctgaaaatccagaatatcctcggaaaaggggaagaatatgaactgattgttattcttgcttcaggaaaaaataagatccggtattacacccggctgatgcagacacaaaacgatgatactcaggcatgtatggattttgcactgcagtttcatgaatatacattccgggatgatgcaaataaatttattccgaaatatatggatgcggcaacaggcgataccagtacactcaattatgtggatttaagctgtaccttaaaccagattacctgggcagatttaaaaccggagcagatgggagaacccgaggcatctttcaaggaaatcaatgattcctatgatgtgatcacactccggtatgtggtgaccaccaaaggaaccggtggggaaaccgagtattataatgtggaagaatattatcgtctgcgtatgacggaatcccgtatgtatgtcttaaattttgagcgtactttaaatcagattttccgtggggaaaaccggtttattacagataataatcagatccaacttggcatacgtgacaaaaatattgaatatgctgtaagtgagaccggagatgtgatcgcgtttgtacagcagggagaactctggtgctttgaccgtgtaaataataagattgtacaggtattcagtttccttggggcagaggggatcaatgcgagggataactgggatcagcatgatatcaaaattgcccgtgtggatgaagcgggaagtattgattttgttgtatatggatatatgaaccgtggggatcatgaaggcgaagtgggcacggcagtatatcattatgatggtctggtacacactatagaggaagaaatttttatcccgtcggatgtttcctatgaaatactcaaagcacagatggggcagttaatgtatgtgaacgaaaaggggacattttacctgatcatggatcagaaactttacagtatagatacggacaagcggactccggaagtgcttgtgaaagatctgaaagaaagctgttataaagtgtcggaatcgaatcagtattttgcgtgggtagacagcgaaaaagaatacaaaagcgatgtgattcacctgatgaatttgaaaaatgcttctgtctatgatatcaaggcaaaaaagggagagtatattcttccgcttgggtttatcgatgaagattttatttacggagcagcaaagaaagataaggtgatggttgcagcagcgggaaatacggttttcccgatgaaaaatttaaccatcatggatacttccgaaaattcacacagtatcttaaagacgtatgaaccgtccaggggaagtatcggttccatttcggtggaggattatacaattaccattcatctgatcaaaaagtccggcggacattatgtggctgcaggaaccgatgcgatcatgaaccgtgagggagacacggaagaaaaagttaccgtgggatcaaccgtgacagatcgcaaggaaacacagtaccagcttatgatgaaaaatggggcagatgcatccaaaattaaaatgctgacttccaaatctgttttactcgaaaatccgcgtgatgtttccgtgaaaaataaggagtcgcaggaatacttttatgtgtacaaaaaaggtgatgtgctgtttgcaaccgatgagatcgcggatgccatcgtctgcgctaataatcatatgggagttgtggtggattccaagcagcagtatgtatggatgcgtgcgcgtaaatcggcacagacggcatttagcagcctgaaagtaaacgatgcggataagagttcatcatccgtggttcaggcggtcagtgccatgcttaattacagaggaaacgggctcagtgtaaaagaactgattgacaatggaggaaccccgaaaagtgcgattgaaaatacattaaaagattctgttgttcttgatatatccggctgcacagtagaggagattctgttttatgtcagcaagggcagcccggtatttgcaatgaccggaacagacagtgccgtattagtgacgggatatacctctggaagcatttattattatgatccgcagacccattccacgaggtcaaaaagttataaagatgcggatgactggttccggaaagcaggatacattttctttacttatttggaccgttaattttcattgtaaaaatgaacaattaaggacaaggttttatggatgattcgtgaagatttaacagaaataaagttaatatattgcaattcctggataagtgagatatatttgagaatgagttatacagttttggaaagggagagcgtatgagtaagaaaaatgtgatcgtttctaatgtgtcagaaggacacgacaatccaatcgcagaacttgttcaggtagcatgtcagttcgacagcgatattatgttggagagcgataaccgtagaattaatgcaaagagcattatgggaattatggcgtttaatccatccgatggaatgtcggttgatattgtgacggagggtgccgatgaagaagcagcacttgatgcaattgaaaaatttttagtatgtgaataattctggttaggaggaatcgttatgcaggagaagaagttaaacaaagcagtttctgacgtgaagctgatgaagacaccagagggaaagacagaagttaaaaatgcggttaaggatgctacaaaaaaggtagaatcaaaagtcggggatgttgctgaggcagcagcaaagaaagcagaagttgtagaagagaaggcaaaagaagttgcaaaggcaacaacaaaggctgttgttgagaaggcagaacctgttgtgaagaaagctgcaacgaaagcaaaggctgctacaaaggcaaagaaagaaaaacagccggcaaagaccgaaatcattgttcagtatcagcagaatgctgcaaatcttggagaacttgaggataaggtaaagaaacagtttgtagctgagggacatcgtgccggatgcattaagacattaaatatttatgtaaagccggaagagtacaaggcatattatgtaatcaatgacaagttcttcggaagtgtagatctcttctaagcgagttttattacccatacatgatataaaggacgactgcagatgcagccgtcctttttacgtggtatgagacaggatattcataaaaaagagtataaaaaaagaaaccggataaacagtttctttaaaagagcgggtgatgggaatcgaacccacgtatccagcttggaaggctggtgttctaccattgaactacacccgcatatagtgcctagttccggaatcgaaccagagacacgaggattttcagtcctctgctctaccaactgagctaactaggcattgcagtggatttcttaattgaaaatctcacgcggaacatttagtattatatccgagtgagatcttcttgtcaagaaaaaaatcattatttttgatttttttgaatatcctgtgtgtagcagcgcagaatttctccaacgctccatgcctgggcatagcaaccacggcaggtatgcggggcatcaccgtcaaaaatttcggaaatagaaccaatgcagccctcttccaaaaggtgggtctgtaccggtgcaagatataccattgcctgtttttttgcttccggagagtggtggtggactttcatgtaagcagtcagaaagccgcccatcagaaatccccatgcggttccctgatggtaagcggcatctcttttcggaagagagccacagtagatcccgtgatagtctttgtgttccggagagagggagcgtatgccggggccggcaagcagcttttcctctacggtatttaccacctgcagagcctgttctgccgtgagcatggtatgtggaaggctgacggcatagatctggttggggcggatgcttgcatctttgccgttttcttcaataacgtcatagagacatccgtctttttcgttccagaattcttttcggaaggaagcagatacacgagtggcaagctggcggtaaacggaggaatcttctttgaaatgttctgccagttccgcagtcacgcacagcgcattgtaccacagtgcattgatttctaccggttttccgtgacgcggggtagctacccagtcaccgacacggacatccatccaggttacctggtccaatccgcttccggcatggatgagggcgtcatcatccatatagatggaaaaatccgtgccgtgtgcataggcatgaataatttcacgcagaacggggtaaatacgctgctgtatatagtcataatccgatggttgtccggtaaccttcaaatatgcgtccacggcataaaaataccacagagaggcatctgcagtgttatagagagggtcctgcccgtcatccggaaacatattcgggaccatgccgtgatggacatactgcgcaaaggtcgaaagaatttcccgggcatccgaaaaccgccgggtggccagtgtcagcccggaaaaagcgatcatggtatctctgccccagtcggtaaaccacggaagacctgcaaggattgtcataagtccagtggaatcgcgccgggcaagaaactggtctgctgccacgacaagtgtattggcaaaagcatcatcgccatatcccgcctgttgttttaaggaatcataatattcctgtacgtgtgcgatttcgattgctgcggtatctgcctgcgggcgggaaaacacaggggtgtcctgtaccgggtggacggtgcaaagcagggaaatctctgtactgctgtgtgccggaagtgtaaaacgcagatcatatgggcaaaaatgtgtatccagtcctgccgtttcgttgtctacttccgtctggtactgcatatccacgtcgtattggttttcacgtggaaaaagtctgccggcactgcaggaaagctcgatgcagagtccgggtgcagcagccgggatcagagtgaaaccgcccactgtgtttggctcacaggtaaactgcaggtcagaaacggcagacgatgcactgtgctcccggaaattcataagcggggtgatggaaagtccggcttcctctccctggtttgtaatcgtataggagatcgcaactgtgtttgattcccgcagcagggccagatgtttgtccatacggatattgccggcggcataggaaaagcagacagttccgtcacaggagaaatccgttaaaaaacgctgtccttgcgtgcggatgggagaatgtcctttcccggcatgctgggaagtttccagattgtaaacatgggttccctgtgtcagtttttcattggttttggaaaataccagatagcgctcgaccgggggatgcagactggcaatcagatatccctgatgtgtccggttgcaggcaccgatgatggagcctcccgcgtatccgccgattccattggtcatggtccattcacgacggatgtttttttcaaaatctgcaagtttttctgttggaatatgtatcatatgcacctccgaaaataaacgaaaaataatatctcttattgtaagggctggggaacaaaaaatctactgtatttatgaaaaaattattctctagtggaaaaaaagtgtgggatggagtataattaacattactacaaatgaaggagagatagaagattggaagtatatgtattagtaccggtccggaagaccgtggttgcaaaagtagtggggacattgatgcttgtacttgcagtagtgagtctgcttgcagcatgtctgaccagtggcattacattaccggttgcactggtatgcggaattgtctggtttgttctgatgggaaactccaaggagtttgagtattcttattttgacggggaagtccgcttcgcaaaagttttaaacaagaaccgcagaaagtcactgggaggttatccgatggatgatgtaattcagattgcaccggccggagatcgcagtgtatcacaatacgagagagagggtgtcaaggtgattgattatacctctcatgacaaagatactgcatattatgatatggttctgaaaaaggaaggcgagacactgctgatcaaatttgaaccggatgataaatatctggaagcagtggagtttaaatacagacaaaaagtaattcgcagaagtacacaggcgtaagaaaaaggggtgccgaaatccggcatccctttcctgtgagtggatagttcttatttcgttttgtcagaaggggtatcgagatagtgcatgcgtgaatccggtgaaatggcaggggcaacggatctgccctgtgtgttcatcagtttcagacaattcggacacagggtaccgaaagaaaccggagcaccacagcgctggcagtgcatgccggagatagtggaagctgtgttgacctcatgatattcgatccggccttcccgaatccactctttgatctgccggagaggaatatggaaatgttctgcaacttcatattcatttacagtgttggcgcggatataatcccgcacattccggaaaagctgtgcttcctgacaagtgggacatagcgttccttcataatgttttggaagcgtgcgtccgcaaaattcacagtatttatatttatcggaaatatttttttcagtcagcatagttgtcactctccattgctatttactagttactattataacaactgaaccatgttttttcaattaagaaaggataacagatctgtggaatatcaattacaaagagaaaacccaattgcggtatttgactccggagtgggaggaatcagtgtcctgcgggaactgatccggattatgccggaggaagattttatttatttcggtgattctaaaaatgcaccatacggaacaaaagaaaaagaaaaagtgcgggacctgacgatcggatgtgcacgaaagctgtttgaccagggggcaaaaggtcttgtggttgcctgcaatacagccaccagtgctgctgtccggaaactgcgcgagatgtatccgtatattccgattgtcgggattgaaccggcactgaaaccggcggcactttgcatggaacatcccaaagtccttgtgatggcaaccccgatgacaattcatgaagaaaagtttcatgtgctgatggagcgctacaaagagaaagcacaaattcttccgttgccgtgtccggggctgatggattttattgagcggggagatctcgacggagaggatctttataaatatctggaagatctgctttattcttaccgggaaaaccaggtggatgcagcggtactcggctgcacacattatccgtttgccagaaaacagattcagcaggtgttgggggagaatgtgaaaatttttgacggaggcgagggaaccgcacgcgagatgaaaagaagactgcaggagaaagatctgctttgcggccggcagaaacgtggacaggtggtatttgaaaacagtctgaccgatgacagcaagatcgaattatgtaagaaattgttaaatatataaaatgtctctaaaatttttggaatatgattttagaatttgtttttgaagtggacataatatggacacattttttgcatatactagacaatgtaaacggaaatcattcctttacattattccctttttatttaataaacattttcataactaaactcctcgaagagaagccgatccgggaacggagaggcttctcttcattttgtgacaaaatgctgcctgtgaaataaaatacaccgtgtggatgcaggctttctttatatggagaaaatatacaaaaataagtgaaatggagattggaactttgttaattatttgacgaattagcggttacttttttgggggctgaggtgtaaaatatacagagattataaggaggtacaagaaaatgggtaacataccgctttggctgtgcataccgtttgccggccttttattatgtatcgcaattttcccactggtaaaaggagaatggtgggacaaaaataaaggctgggcggtactcatctggtcacttttatttattattccgtttgcagtaaaatacggcgcaggcgagactgcagaaacagttctggaatgtatagtgaatgattatctttcctttattgtattgctgtttggtctgttttgtgtttccggaaatattaatctggaaggagattttgtcggatcaccgcgtatgaataccggacttctggcgatcggaacactgctttcaagctgtatcggtacaaccggtgccagcatgcttttggtgcggccgatgattcagatgaattcctggagaagaaataagagtcatattatggttttcttcattttcctgatttccaatatgggtggatgtctgacaccaatcggtgatccgccacttctgatgggatttatgagaggtgtaccgtttacctggagtttacgtctgttcccggtactggtatttaatatggtaattctcctgaccgtattttattttatcgaccgtcgtgcataccgcagagacattgcacttggcatgcgtccggatatttccagaccaacgactacttttaaagtcaatggtctgcacaacattatttttatggttatgattgtggcaggtgttgtattaagcggcgttcttccgggaatgaaagcattccagaatgcagacggaagcgttatcagtattccgattttccggagcgtaagactggcagtgccgacactgatcgagattattattattctggttgcagcgtttctgtcatttaagacaacgaaatccgatgtgcgcacaaagaaccactttacctggggtgccattgaggaagttgcagtactgtttatcggaatttttattaccatgcagccggcactcatgatcttaaagagcaaaggtgcggaactgggactgacaaaacctttagagatgttctgggcgaccggtgcactttccagtttcctggacaatacaccaacctatctggtattccttacaacggcaggaacactgggcgcaaccagtggtattgccacaaccgtgggaaccgttgcggtcaagatgcttatggcaatctcctgtggtgcggtatttatgggagccaacacatacatcggaaatgcaccgaactttatggtgaaatccatctcggatgaaaacggtatcaagatgccgtcattctttggttatatgttatgttccctgaagtttttgattccggtatttatcattgatacactggtattctttttataggaggtagaaggctatggacaacaaagaacaatgcagaaagctggcgaaccgcatctatgaactggatgaaaaggtgtacaagacttccggttctggactcggaaagacatttaccggagaaaaagcgcgtgtgctggatgacctgaccatgcttattgtttccaatccacaggggcatttgcttcgaagtgaactggctctgatcggaaacatggcgagaagtatccggaataaagaagcacgccatgaccttttggttgaatataatgatattctggaagaaatagcaaatctgccgatgagctttggctcggtagatattgtggataaagatctggcagatatgaattcttcgattctgagcaagaagttttctgagaaggatcatctggtaatttgtatcagccgttcccatggaagtgcaggtactgatattggatttgcactggcggaagcactgcatatcaattattatgatgaatcggtattgaatcagattctagatcgcagagatgcaaaagaattcggggcagatgcggcaaaagtcagcgattttaagcgttatcatggtctgtcaaagaaagacgcatctttcttccggcagagtgccttaatctgtgagctggcaaaagaggaagatatgattgttatgggacgtgctgcggatgtcgtactgaccggacagcatattccgcatatcagcatctatattacggcaccgtttgcgatccgtgtgcgccgtatgatggaactgaaaaatctggatttgaaacaggccattaatctggtgcgcaagatggatcataagcaccaggattattatcattcctttaccggtaagcgctggggtgatgcgatcaattatgatctgtgtatcaacagtgcatgctacggaattgatgagtcggtagaactgatcggacgtctgatcaaccggcaggcaaaattggtacatcgaaataaagataccaaatagtgtggataaaaccaatagacttccgtcttcgttaaacggcagtttaagaaaacgttaagatacaacaggtaaaacattaagcgtacaaagatataattggaaacagataaaagaaaaggagtttcagtcaaatggaaaagaaaaaattgctgaaaaacaaaattgttgatacgcttccggtgctttaccttgaaactgtgattctcatggttttaggacaatttctaggaaactttgttctcggaatcccggtggggattgcctatgcaagaaaccctgagatactaaattctgcgtttttgaatacgacactgatgtatgtgatcttttggggaatctgggccgtggcattgttctggatcggtatccgaaaacggaatcgtccgattttacaggcagtcggcacgaaaccacagggaaataactggaaatatctgctgttcggtttggttctgggatttgcactgaatggattttgtattctgattgcatggctgcaccatgatattgtgctgacctacgatgcaattcatccgctgtggtttgtggttgtgtttctgaccgtgtttatccagtcgtcggcagaggaactgctgtgcaggggatttctatatcagaaactgcgcaggagttataaaaatccggtggttgcaattgtcggaaatgcactgctgtttgcgttgctgcatctggcgaatgatggagttacggtgctttctgtcctgaatatttttcttgtcggaattttgttttccctcatggtatattatatggacagtctctggtgtgcgtttgccgtacatacagcatggaattttacgcagaacattctctttgggctgccaaacagcggaatcaacgtaccgtattcggtatttaagctgaatgcagcgacagcaagagacagtttcgcatataatgttggttttggcattgagggaacggttcttgccgatattgtacttctggctgcatgtgtgctgttgtatctctgggggagaaagtatggaaagaaatccatggatgtgtgggcagaaacataatataattagtattttacgaaaacggcaccaggttacatctggtgccgtacaactttgtattcgtccccggaacggtaaaagggacattccttgtaattactctggacaaaacgagccatgtcgtcttcatccatattgacggagcagtagtacgcttcgtcctcttcatcatattcattgtatgcacaaaaatcacaactggccatacaaaagttcccctccttttatgaagtgaatcaggcgattgcctgttaaataaactgattctgcccctcatcgtaatgataattgatggcagcaagggtttctgtaattgcatctgcatctgtcatatatgcggcagcaagttcggtaagtgtcgggtaatgatcacgcagctgtgtgttgacaacagacagaagcatgacaggatctttcggtaaattcatagtatattcctcctttggaaacgattattgcatatcggtataactgcgcaggatttcctgcagaaaaatttggtattcattgacaacggaatccggggaaatcacacggatatgtgtggataagccggcaagccagccgaaaaactgtggactgacagcaacctgtgcccgtgcgagaatgtgggtatcatcgtaggggcgcatggctacactggcaccaaagcggtcaatgatgacaccggtcatggaagtatcgcacagaagctgtacggttgtctcttccccggcaaacatgccgaaatttttgcgggaataagaggcgatatccatctgttcgtaatcggtccgtccgcaccgcgcctgattcacagcggagagatcaagcatcttgtcgacacggtaatgtttcattttcccggcatccgcgtcataggcaacaagataatagttttcgtcatcccaggtaagaagccaggggctgacctgatagaatctgccgtctttgcgcagctgcatttcttttctgacattccagtcgaagtagtggaaacggatctgccggttttctgcaatggcagaatggatgacatccacgctgtaatagattttttcattgctggttttgttgcggtctgcaacgataacctgacgctgtagttttttcgcatcgtttttactgacaagctgttccagtttgccaatcagctgccgtgatttctttgtggtaataaatttggaagactgtaccaggtcaacaagcagtttgacttccggcagctcaaatgtgcggtctgctatgcggtaaccggcatgcgcgccttcggtccggatgatgtcataaccataatcacaaagcgtctggatatcgttatagatgcttttacgctccgcccggatgccgtttgccgcgagatggtcgatgatctgtggggtagtgacggtatgggtttcatccgtgttctgacgcagataatccagaaggaataacagcttttgtttttgattcacagatttgggcatgacagttctcctctttcaaataaagtgaaaacccggcggaaaaaccgccgggaattacattatcgtttacacttggttgctgcttccacaaaaccacggaacagtggatgtggacggtttggtctggattttaattccggatgtgcctgtgtggcaataaaccatgggtgatccgggagttcgatcatttctacaattcttccgtccggagaagttccgcaaagtttcatgccatgctcggtgagagtggcacgataatcattgtttacttcataacgatgacgatgacgctcggaaatctcagtggttccgtatacttcatatgctttggaatccttgtccagtacacaaggataagcgccgagtcttaaggtaccgccgatatcttctacaccgtcctgatccggcatcagtgcaatgaccggatgtgttgtgttcgggtcaagttcgatactgtgtgcatcgttgaatccgcatacgtgacgtgcaaattcaatgatggatacctgcatgccgaggcagagaccaaggtacggaatcttgttctcgcgggcatagcgtgcggcaaggatcattccctcgacaccgcgcagaccgaatccgccgggaacaaggataccgtttacatcacccagcacctcatctacattgtctacatttaattcttcggagtctacccatttgatgtcgattgttgcatgctctggaataccgccgtgctttaaagcttccacaacggaaatgtaagcatcgtgtaatgcggtatattttccgaccagtgcaatccggacttccttgtccggatgacgcagatcattgaccatggacttccagtcacttaaatccggttccggacagtcaagatttaaacactcacaggcaattttcgcaagattttctttttccatcgccaatggagcttcatataaatactcaacatccagattctgcagtacatgtgtgttcggaacattacaaaacagtgcgatcttgtcctttaatccctgatctaacggctgctcggaacggcagacgatgatatccggctggatacccataccctgcagttccttgacacttgcctgggtaggcttggtctttaattcctgtgaggcacgcaggtacggaatcagggtaacgtgacagagaatcgcattctcatgtcccacttcgtgctggaactgacggattgcttcaaggaaaggctggctttcgatatctccgacggttccgccgacttctataattgcaatatgcatatcatcggatgtgaaattacggtaaaaacggctcttgatctcgttggtaatatgcgggattacctgtacggttcctccgccataatctccacgacgttctttctgcagaacggaccagtaaaccttaccggttgtcacattggaattctttgtcagactttcgtcgatgaagcgctcgtagtgaccgagatccagatcggtttccgctccatcatccgttacgaacacttcaccgtgctgaatcgggttcatggttcccggatcaatgttgatatatggatcgaacttctgcatggtgactttgtagccacgcgctttgagcagacgtcctaaagatgcagcagtgataccctttccaagaccagatacgacaccgccagtgacaaagacgtattttacaggcataattttcctcctaagtttttatctaaactaccatagtttaatattatacagcggacaacgaaaatattccacacttttttataaaaagtttagaaaggataggaaaagttctcgaacaaaatgttgattttgcgtttcttattacatataataagggtattgattacaagagatatacaagtggagggcttatggacaatcaggcaccgaataattataacaacggaaactataacggtggcaataattataataacggaaataatggaaacaatggtaataacggaaacaacggtggcaacaacggaggaaagaaagacaaccataacggacagatgatcctgggatttatcatggtcactctggtggcactctttttcctgtcattttttgccaaccggttttcacagatgagttcgaaggaaactacatactccgaattcctaaaacagctggaaaagaataatgtcaaaacggtggaattcagcaattatgagatggattacacactggtggacgataaaaaaccatatgagataacatattacaccggaattgtcaatgatccggatctgatcacgacactcaagagtgcaaagacatcagaggggaaagcaattgaaatttcggcatccgtgccggacaatacttcggcatggctggtaaacattttaagctttgttattccgctggtactgatctggattctttttggattcctgatgcgccggatgggcggaggagccatgggggttggaaaatcaaccgccaaagtatatgtggagaaaacaaccggtgtgacatttaaagatgtagccggacaggacgaggcaaaggaatccctgcaggaagtggtggattttctgcacaatccgaagaaatacagcgatatcggggcaaagctcccgaagggggcacttcttgtcggacctcctggaaccggtaagacattgctggcaaaagcagttgccggagaggcaaaggttccgtttttctccctggcaggttctgagtttgtggagatgttcgtcggcatgggtgcttcccgtgtgcgtgatctgttcaaggaagcgcagaagatggcaccgtgtattatttttattgatgagatcgatgcaatcggtaaaagccgtgacagccggtatggcggtggcaatgatgagcgtgaacagaccttaaaccagctgcttgcggagatggatggatttgatgcatccaaaggtattttaattcttgcggcaacgaaccgtccggaagttctggataaggcactgcttcgtccgggacgttttgaccgtcggatcattgttgacaagccggatctgaaaggacgtctggaaacgttaaaagtacattccaaggatgtacacatggatgaaacggtagatctggatgcactggcactggctactgccggtctggtgggatcggatcttgccaatatgattaacgaggctgccatcaatgcggtaaagaatggacgaaagtttgtcaatcagtcggatctgtttgaagcatttgaacttgtggctgtcggtggaaaagagaaaaaagaccgcgtgatgagtgataaagaacgcaagattgtctcctaccatgaggtagggcatgcgctggtatctgctttgcagaaaaatacggagccggtacagaaaatcacgatcgtaccgcgtacgatgggggcactgggatatacgctgcagacgccggaagaggaaaaatatttagagaccaaggacgaacttcttgcaaagattacgacatttatggcaggacgtgctgcggaggtgcttgtattccattccgcaaccagcggtgcagcaaacgatatcgagaatgcaaccaagatcgcgcgtgccatggttaccatgtacggtatgtcagatacgtttggcatgatgtgtcttgctacggtggaaaaccagtatctggatggaagagccggtctgatctgcggagaagacacggcaggacagattgataaggaagtactttccattattaataacagttacaatgaagcaatgcagatgctgacggaaaatcgtgaaattcttgatcatatcagtgaatacctgtatgaaaaagaaaccattaccggcaaggaattcatgaagattttccgcgagatgaaaggacttccgcaagaagaggataaagaagccctgatgccggatgacacagagaaggataaaaaggattccaaagccgcatttgtgagtgatgatatgtttgaggattaaatcatgttcgactttcaggaagaattgcgtaaactcccggatcaaccgggagtttatattatgcatgacaaaacagatgcaatcatatatataggaaaagcagtcagtctgcgcaaaagggtacggcagtattttcagcccagccatgatgagggaatcaagaaaaaacagatggtggagcatattgcacgctttgagtatattatcacggactccgaactggaggcactggtgcttgagtgcaatctgatcaaggaacatacgccgaaatacaataccatgctgcgggatgataagacgtatccgtatatccgggtaaccgtgcaggaggattttccccgggtccttttttcccggcaggtgaaaaaagacaagtcccgttattttggaccgtatacgagtgccggtgcggtgaaagatacgattgaactgatcaataaactttataaactacgcacctgcagccgaaagcttccgcgggacatcgggttggaccgtgcctgcctgaattatcatattcatcagtgcggtgcaccgtgtcagggatatgtggataaagaaacctatggaaaacaggtcagcaaagcactggaatttttaaatggaaattatgcgccggtgctgcgtgaattaaaagaaaagatgcaggaagcctccgaggagatggagtttgagcgggcgatcgaataccgtgagctgttaaacagtgtcagccagattgcccagaaacagaaaattaccaatacggacggagaagacaaagatatcattgcactggcgagtgatgaccgggatgcggtggttcaggtgttttttatccgcagtggaaagattatcggaagggatcattttcatgtgcgcgtgggatcggaagaaagcacgggagatattctggtaaattttgtgaaacagtattattccggcacgccatttattccgcgggagattatgctgcaggaggcgatcgaagacattccggtgctggaagaatggctgagtgccaaacgcgggcggaaagtgacgatacggattccgcagaaaggactcaaagaaaagctggtggagctggctgcgaaaaatgcacagttggtgctcagccaggataaagaaaagattaagagagaagaagggcgtaccatcggcgcggtaaaagagattgagcagctgcttggcatgaaagggcttaatcgtatggaagcctatgatatttctaatattaatggatttgaaaccgtaggttctatgattgtatacgaaaaaggacggccgaaacgcagcgattaccggaaatttaaactccgcacggtatcgggaccggatgattacgcttccatgcatgaggtcctgacccggcggtttacgcacggcatgcaggaacagaaagaactggaagaaaaaaatatgccacaggaagtcggaagttttacacgtttcccggatatcatcatgatggatggcggacgcggccaggtaaatatctgtctgcaggtgctggaagaattgggactggatattccggtctgcggtatggtcaaggatgacaatcaccgtacaaggggactatatttccacaatgtggaaattccgattgaccggcatggagagggatttaaactgattacccggattcaggatgaagcacaccggtttgccattgagtatcaccggtctttgcgttctaagacacaggtgcattccattttagatgacattgagggaatcggaccggccagaagaaaggcactaatgcggagattccagtctatggaaaatatgaaaaacgcatctgtggaggaactggcagaaaccgacagcatgaatctggcggctgcacagaatgtatatgataccctgcattccggaccggcttagcaacttgtgatatggaaagattcatggtacaatctgtttataaaaaggcagtccggcacaggtactgcttaatatgagccacagggggaaatgaatatgtcaaatggaagtgttagtgttgcaaaagttgcgcaggttttaaatctgaaaaattttacgccggatatcaatctgaaaaaatgtaagattatttccagcgatgtgaatcgtccggcattacagctgaccggatattttgaacatttcgaggaatcaagaatacagatgattggaaatgtagaatatacgtttatccagcagatgagtgatgcggaaaagaaaacccgttatgatgcgtttctgaagtttgatatcccatgtgtgattttctgccgcagtctgcagccagatgaaattttcttagaagaggcaataaaaaatgaagtgccggttcttggtacggatcgtccgacttctgaatttatggcagagctgatctatacactgggtgaagaactggcaccctgtattaccgttcacggggttctggtcgatgtatatggcgagggtctcatgattacaggagacagtggaatcggaaaaagcgaggcggctctggaactgatccgccgcggacatcgtctggttacggatgatgtagtggaaatccgaaagatcaatgaacatacactgatcggaacttctccggaagtgacccggcattttattgaactgcggggcattggtatcatagatgtaaagactctgtatggtgtagagtgcgtcaaggaaaagcagcagattgatctggtgatcaaactggaagactggaagaaagatgcggattatgaccgcctgggactggaagaagaatatatcgaatatctgggcaacaaggtagtatgccattcccttccaatccgtccggggcggaatctggcggttatctgtgagactgcggctgtcaaccacagacagaagaagatgggctacaatgcggcacaggaactgtatcgcagagttcaggcaaatatgacaaaaagtgacgatgaagaatagacgagagtaaatgaggagatgtaagaaatcatggaaaagaaaaatgcgtgggagaaatacccggaaggaaccaaaagacaggatgtatttacatttgcggaagaataccgtaagtttatatcttcctgcaagactgagcgcgagtgtgcaggggaattctaccggaaggcaaaggaagccggatttgcagatctgagtgaaaagattgcgcagaatacaaaattaaaagcaggagaccgcattgttgccaataatatgggaaaaggtctcgctctgtttgtgatcggtgaaaaagacatcgaggaaggaatgaacattctcggcgcacatattgattccccacgtatggatttaaaacaggtaccgttatatgaagatacggagatggcactgttagatacgcattattatggaggtgtgaagaaataccagtgggtgacacttccacttgcactgcacggtgtaatctgtaaaaaagacggtacaacggttacggtcaatatcggagaaaaaccggaagatcctgtttttggcgtgagtgatctgctgattcatttagcgggagaacagatggagaaaaaggcatccaaggtgatcgaaggagaaaaccttgatctgcttgtcggaagtattccggcagcaagtgatgatgaaaaagagaaaaaagagatgaaagaccgcgtaaaggcaaatattttaaatattctgtccaaagagtacggtgtggacgaggaagattttctgtctgcggagattgaagttgttccggcaggggctgccagagattacggctttgaccgcagcatgatcatgggatacggacatgacgacagagtgtgtgcttatccgtcttttgcggcaatgcttgagattgaaaagccacagcataccagcgtatgtcttctggtagacaaagaggagatcggaagtgtcggtgcatccggcatgcagtcccatttctttgaggacagtgtggcagagatcatcaatctgcttggggaatacagcgaattgaaagtgcgcagagcgctgcataattccagagtgctttcttccgatgtatctgcggcatttgatccgaattatccgtctgtgatggaaaaacgtaactgtgcttactttgggaagggacttgtcctgaacaaatatacaggagccagaggaaaatcaggttccaatgatgcaaatgcagagtatattgcaagactgcgcagaatttttgatgataatgatgtatcgttccagacatcagaacttggaaaagtagatcagggcggcggcggaaccatcgcatatattcttgcaaattatggcatgaatgttattgacagcggagttgccgtactgaatatgcatgcaccatgggaaatcatcagcaaagtggatctgtatgaggcattgcacggctatgtggctttcctgaaggaggcataatggatcagtggcttgaagaaatcagggcggcattgcctgagctggtcgtatatcagcaggaaccgatgaaaaaacacacgacatttcgcgtgggaggtcctgcggatctttacgtgtgtccaaagaaacaggaacttccggtaattcttggcctggctaaaaagaaagggcatgcagtgacagtgatcggaaacggaagtaatcttctggttggagacaaaggaatccgtggacttgttattgaagtcggggcacagatgaatgcggtggaagtgcagggaaatatcctgcgtgcgcaggcaggtgccctgctttcccaggtggctgcaaaagcggcagctgccggtctgggcggcatggaatttgctgccggaattccgggaagcataggcggtgcagtgaccatgaatgcgggtgcctatggcggagaaatgaaagatgtcatccggcaggtgacagtgcttaccccggagtgtgagcaaaaggtactctcacgggaggaactggatctgtcctacaggcacagctgtattcccaagaatcattttctggtactggaggcagagttgtccctgacgccggcaccggagcaggagatccgtgcaaagatggcagaactcagggaaaaacgtgtggagaagcagccgctggagtatccaagtgcaggcagtacgtttaagcgtccggaaggctattttgcaggaaaactgattatggatgccgggctgagaggctatgccgttggggatgcccaggtttccgaaaaacactgcggatttgtgataaacagaggaaatgccaccgcagcagagattttgcagctgatgaaagatgtacaggaacgtgtgaaaaaacagtctggtgtgacacttgaaccggaagtgaaaatgataggagagttctagatgagatttgtaattgtgacgggcatgtcaggagccggaaaaagtacagcaatgaaaatgatggaagatatgggattcttttgtatcgataatcttccgattccgcttctggataaacttgtggattttgcaacaaattttgatacgcagatgaaaaatgtggcgatcggaattgatgcgcggagcggtgaaaatctggataaagtgcaggatatgctggaaattttaaaaagtaaggatgtccagtatgaagtgctgtttctggatgcagaggatgcggttcttgtaaaacgctataaagagacccgaagaagccatccgctggcacagggagagcgtgtggataagggaatcatgcgggaacgtcagaaaatggaatttctgaaaaaagaagcggattatattatcgacaccagccgtctgcttacgagagaattaaaaacagaactggaaaagatctttgtacaggatgaagaatttaacagcatgtatgttacgattctttcttttggattcaagtatggaattccggcagattctgatatcgtcatggatgtgcggtttctgccaaatccgtattatgtggaagaacttcgtccaaagacaggaaatgatgtggaaatccagcagtatgtcatgaaatatgatgaggcaaagatctttttaaacaagctggaagatatggtgacatttctgattccacactatatttccgagggcaagaatcagctggtaatttccatcggatgcaccggaggaaaacatcgttccgtcacacttgccaatgaattgtacaagcgtctgagtcagaaaaaaaaccgggaatacggattgaaaattgaacatcgcgatatcgggaaagatgcgctgagaggaaaataggatgtcgttttcgagtgaagtaaaagaggaactggcaaaacagttcggacggagcagacattgccagatcgcagaactggcaggaatactggaactggaaggcatgctggatgaagagggaaagcttgtagtttccaacgaaaattctttgctgcagacaaaatatggtctgctgttgcaaaaaatatttggagagaaacaggaggttttacagatcatgcagacactgcactgggatcaggaaccgtaccggtcccggaaaataaatcaccggagagcggatgggatgctggtgcagcagacatgctgtaagagagcatttatccgtggagcatttatggcagcgggatcgatcagtgatccgaataaatcctatcattttgaaattgtctgccatacgcttgaacaggcacagcagctgaaagaactgatggaattttttgagacggagcctaagattgtagaacgcaaagagcgtatggtggtttacctgaaagaaggttcacagattgtggatctgctgaatgtcatggaagcttatgtatctttgatgaatctggaaaatgtaagaattttaaaggagatgcgcaattctgtgaaccgcaaggtaaactgtgagactgcaaatatcaacaaaacggtgaatgcagcagtgaaacaaatggaagatatcaagaggatccgggataccatagggtttgacaacattccagaaccgctggcggagattgcacaggcacgtctggattatcccgaggcaactttaaaggaactgggaacttatcttgatccaccggtcggaaaatctggtgtgaatcacagattacggaaacttgccgcaattgcagaaaatcttatataaaggggaactacgtatgagccagaagctattatttatttttaatccgcatgcaggaaaaggacagattaaaaatcatcttgtagatattgtggacatgatggtgaaggcaggatttgacgtgacaatttataccacacaggcacaggcagatgcgacgcgcaaggtggtggaagagggtgcgggatatgaccgtattgtctgcagtgggggtgacggaacacttgatgaagtgatgaccgggctgatgcaggcgaagctgcatattccgattggatatattccggccggaagtacaaacgactttgccaattctctcggaatcccgaaggagatgctaaaggcagcggaacgtgcggttggacaaaacagatttccatgtgatatcggagatttcaattcggatacctttgtctatatagcagcgtttggtctgtttacagaggtttcctataagacatcccagcagctgaaaaatattttcgggcacgtggcatatattatggagggtgtcaaacagcttcgggacattccatcgttccgtatgcaggtggaatatgacggaaaagtgtttcaggatgaatttatatacggaatggttaccaattccgtttctgtcgggggctttaagggaatgaccggaaatgatgtaaaacttgatgacggtttgtttgaagtgactttgatccgcaatccgaagaatccgattgagctgaatgaaatccttgcctgcctgacaaatatgattgatgattcggatctgatttattcgtttaaaaccgatgctgtacacattacggcgaaggaagaagtaccgtggacactcgacggtgaattcggcggagcacaccgggaagtagtcatccgaaatttgaagcagagagttgaaatattttgttaaaaaattaactttatttttggggaaaagtgtactataatctaggtaacttatgattaggaggaaatacaaatgttagtatctgcaacagaaatgctcaaaaaagcaaaagcaggccactatgcagttggtcagttcaatatcaataacctggagtggacaaagtccattcttcttaccgcacaggaattaaagagtcctgtaatccttggtgtatctgagggtgctggtaagtacatgacaggtttcaagaccgtagcagctatggttaaggctatggatgaggaacttggaatcacagttcctgtagcacttcatctggatcatggaacatacgaaggatgctacaagtgtattaaagcaggattcacatccatcatgttcgacggatctcattatccatttgaggagaaccttgcaaagtctacagaattagtaaatgtagcacacaacttaggactttctatcgagtgtgaagttggttccatcggtggagaagaagacggtgttgttggtatgggcgagtgcgcagatccggacgagtgcaagacaatcgctgatcttggtgttgatatgcttgctgccggtatcggtaacattcatggaaaatatcctgcaaactggaagggattaagcttcgagactctcgatgcaatccaggctaagaccggtgttatgccattggttcttcacgggggtacaggtatcccggctgatatgatcaagaaagcaatctctcttggtgtatctaagatcaatgttaatacagagtgccagttatctttcgcagatgctacacgtaaatacattgaggctggtaaggacttagagggcaagggatttgatcctcgtaagcttcttgctcctggtgcagatgcaatcaaagctactgttaaggaaaagatggaactgttcggttctgttggaaaagctgaataatagaacatgtacaaaaggaagtgccgcatgacacttcctttttttcatttcataggaaaaaggctggtatgcctcatacaaagaaattagaaaatgtacctgttttgtagtagaactggaagaagtagacaaaaaagaagtagattttgatagaaaaacgtcaaaatgtataaattataaaaaaattctaaaaagaggttgcattttgtgttggaaagaggtatcttagtttcagattaaacatgagttaagaacgagggcgttccaatatagctattggaatgcccttttttagtaagatgactgatgtttggtgaataagcgtacaatcaggggatttgattgtgaaaagaaaggatgttgtaaaaaatgagtgattattttaacgttgcagacatttttggcgagaacgtattcaatgacactgtcatgcaggaacgtcttccaaaaaaagtttacaagaaacttcacgaagttatggatgaaggaaaagaacttgatcttgagaccgcagacgtcatcgcacatgagatgaaagagtgggccattgaaaaaggtgcaacccattatacccattggttccagccattgactggtgtaacggcagagaagcatgattcttttatcacagcaccgatgccaaatggcaaggttctgatgagcttttccggcaaggaattgatcaaaggtgagccggatgcatcttctttcccgtctggtggacttcgtgccacttttgaggcaagaggatatacagcctgggattgtacatcacctgctttcgttcgtcaggatgcagcaggagcaacactttgtattccaactgctttctgttcctacactggagaggcattggatcagaaaactccgcttcttcgttctatggaagcgatcgatacacagtccattcgtctgttaagactgtttggaaacacgacttcaaagaaggtaactccttctgttggaccagagcaggaatactttattgtagatcgtcagaagtatttacagcgtaaggatctgatctttaccggacgtactcttttcggggcaatgcctccaaagggtcaggaaatggacgatcactatttcggagcaatccgtgagagaatcgcagcatacatgaaagatgtcaataaagaactctggaaacttggagtatctgcaaagacacagcacaatgaagtagctccggcacagcatgagctggcaccaatctacgcagagtgcaatgtggcagttgatcataaccagatcatcatggagaccttaaagaaagttgccggacgtcacggattacagtgtctgcttcatgagaaaccatttgcaggtgtcaacggttccggaaagcatgacaactggtccatcacaacagacgatggaatcaatctgcttgagcctggcaagacaccgcatgagaatgtacagttcttactggtacttacctgtattttaaaggcagttgatgagcatgcagcacttcttcgtgcagcggcagctgatgtgggaaacgatcacagactgggagcaaacgaggcaccgccagcgatcctgtccatttaccttggagatcagcttggagacgtattaaatcagctgatcagcacaggtacagcaacacacagtctggaaggagagaaacttgagaccggtgttaagacgattccggatttcatgaaggatgcaacagaccgtaaccgtacatcaccgtttgcctttaccggaaacaaatttgagttccgtatggttggttcccaggattccgttgcacaggcaaatatcgtattaaataccatcgttgcagaggcattttcagatgcctgtgacgttcttgaaaaagcagacgatttcgagcttgcagcacatgatctgatcaagaaatatgctatcgaacatcagagaattgtattcaacggaaacggatactctgatgagtgggttgcagaagcagaaaagagaggacttccaaatatcaagtccatggtagatgcaattccagcatataccgctccggaatctgtagctgcatttgaaaaatttggagtatttaccaagcctgagcttgaatcccgtgtagagatcgagtacgagacatatgcaaagaccatcaatatcgaagcaaaggccatgattgacatcgctggaaagcagatcattccggctgttatcaagtacacaacagaacttggacagtcaattgcaacggtaaagagtgcatgtgcatctgcagatgtcagcgcacagacagatattttgacagagacatcctccctgcttgctgagacacagaaagcactcaagagtctggaaactgttactgcaaagggaacagaaatgagtgaaggtaaggtgcaggctgtatattacagggatgaagtcaaatctgctatggatgcactccgtgcaccggtagataagcttgagatgatcgttgacaaggatttatggccaatgccatcttatggagatctgatctttgaagtttaacccaaagatttaagggacattttttacaaacatcttataaaataaaaaagagacattttttcagaaccacgaagctgtggaattttggaaaagtgtctctttttctatagagggaggagattgttatggataaacaacaaattgtaagttttatcaatgaaaatatgtttggcatctggtttctgatcggtgccgcactggtattctggatgcaggcaggctttgccatggtagaaaccggttttaccagagcaaagaatgcaggcaacattttgatgaagaacctgatggacttctgtattggtaccgtaatgtttatcctgatcggtttttcattattgctgggagaagatgttcttggttttatcggaaaaccgggatttgatatctttaccagttatgcaaattttgatttttcgaattttgtgtttaacttagtattctgtgcaactacagcaacgattgtatcaggtgctatggcagagcgtacaaaattcttatcctactgtatttattccgcagtaatttcggcattgatttatccgattgaagcacactggatctggggtggcggctggttatcacagcttggtttccacgattttgcaggttcctgtgcgatccatatggttggtggaatttctgctctgatcggtgcagcaatgcttggaccacgtattggaaagttctcaaaagataagtctgggaagattacaaaagtcaacgcattcccgggacacaatcttccacttggatgccttggatgttttattctctggtttggctggtatggatttaatggcgctgcatgtacttccggttcacagcttgccagcgtatttcttacaacgaccgtagctccggcagttgcaacagttgtatgtatgatctttacatggcttaaatatggtaaacctgatgtatcaatgtgcctgaatgcatcacttgcaggacttgtagcaattaccgctccttgtgacgtgaccgattgtttcggtgcaatctgtattggttttgtttccggtttactggtttgctttggtgtatggcttttggattataagcttcatgtggacgatccggttggtgcggtagctgtacatatgatgaatggtatctggggtacgatcgccgttggtttatttgctaccaaatccgcaccgggaaatgattcggtggttggtttattctatggtggtggattcagacagcttggtattcagctgttaggttttgttacggtagctgcatggacagctgtaaccattaccattgcatttatcgtcattaagaaaacgattggacttcgtgttacagaggaagaagaaattgttggtctggattctatggaacatggacttgcatcagcttactcaggattttctatcatggatgtttccaataccatgacaatggatatcaatgaaaatacagatttgggtacaccggaatatgcacaggcttcccagacaaaaagagatgcagctgttaaagttgtctcaacagttccgaaggatgcaaccggtatgtacaaagtggttatcattgcaaaactttcccgttacgaccacttaaagaaagcaatgaacgatctgggtgttactggtatgacctgtacgcaggttatgggatgtggtatccagaagggctccggcgaacgttatcgtggtgctgaagtcgatgcaaccctgcttccgaaaattaaggttgaggttgtagtaagcaagattcctgtagacagtgttgttgctgccgcaaagaaggctctttataccggacatatcggagatggaaagattttcgtatacgatgtggcaaaggttgtcaagattcgtaccggtgaggaagatatggaagctttacaggatgtcgaataattttgcactaatctaatggctaggttagtgaaatctaatccccttagttttagtatacatcaacagcggacccctggcgaaagccgggggtttttgctgtgctgacttgaaaaagtaaattccagtgcaggggtaaattccaccacgctttaaaattctttgattttttagaattgtgggaggctaaatccttataaaacttatctataagcaaaaggacgcatgaaaaaactttcgttttttcacacgccctttttttacttgtttattgcgttaaagtatagtagtgttaaaatataaaaataccaaggaggaaaagttatggggaaagggacgattcgtggccggattgagctggctatttatccgtggtctgttaagaccgatggatcatatgaaaaatttcgtgcgggaaactgtaatcggaaaggaagacgggaaaaggttttggacagcatcggaacattgcagcagacagtgaatgaatttcagatataaattgttcgtgaaataaaaacaacttaataaaaacagaaaatgcggtcatatttatgaaaaaaatatttcatgaatatgaccgctttattgtttgaaaaacgaaagatataaaagaaaacatacattattgtccgacaatattatgtaaaacgaacaatagacaaattatcagacaatataacgaaaaaaatgatttacaagcggtggttataggagtaaaatgagaatcagttaagaaaaagcaactcatgaatgatttacaacgaaaggatagttctatgaaagagcaatggaatgagagcacagcaaccgccaaaggattatatgatccgagtttcgaacatgataactgcggaattggtgctgtggtaaacatcaaaggtatcaagacccaccagaccgtggaaaatgccttgaaaattgttgagaacttaaagcatagagccggaaaagatgccgacggaaagaccggagatggtgttggtattcttcttcagatttcccataagttctttaagaaagcgacagagccgcttggaattaagctgggagaagagagagattacggcgtcggaatgtttttcttcccacaggatgagttaaagaccaatcaggcaaagaagatgtttgaggtaattgtcgagaaggaaggaatggaattcctcggatggagacaggtaccgattcatccggacaagctttccgacaaggccagaggatgtatgccatgcatcatgcaggcgttcatcaaaagaccggaagatgtggagaagggacttgattttgaccgcaagctgtatgtggcacgccgtgtattcgagcagtccaacgatgacagctacgttgcttctctttcgagcagaacgatcgtatataaaggaatgttccttgtagagcagctgcgtcagttcttctccgatttgcaggataaggattatgagtctgcaattgcaaccgtacattcccgtttttctaccaacacaaatccaagctgggagagagcacatccaaaccgttttattgtacataacggtgagatcaacaccatccgtggtaatgcagacaagatgcttgcccgggaagagacgatggcgtccggcaagctgcgcggggaattccagaaggtacttccggtcgtcaacaccgaaggatctgactccgcaatgctggacaatacgctggagtttctggtgatgagtggcatggatctgccactggcagtcatgatcatgattccggagccatgggcaaacaatgctgtgatgacacagaaaaagaaagatttctatcagtattatgcaaccatgatggagccttgggacggacctgcatccatcctgttttccgatggagatatgatgggagcggttcttgaccgtaacggtctgcgtccatcccgttattacattacagacgatgactatctgattctttcttccgaggtcggagttcttgatattgatccgacccatatcgtgaccaaagaccgtctgcgtcctggtaaaatgcttcttgtagataccgtgcagggtcgtgtgattgatgacgatgagttaaaagaaagatatgcggataagcgtccatatggtgagtggcttgacagcaacatcgtcatgttaaaggatttaaaaatcccgaatgagcgtgtgccggaatatacacaggaagaacgtcagagaatgcaaagggcattcggttacacgtatgagtccttaaaggattccatcctgccgatggcaaagaacggcattgagggtaccgctgcgatgggtacggatacaccgcttgcggcactgtccggaaaccgtgagccgctgtttaactatttcaagcagctgtttgcacaggtaaccaacccgccaatcgattccatccgtgaggaggttgttacttctacgacggtatatatcggatctgccggaaacctcttagaggaaaagccggagaactgtaaagtacttcggatcaacaatccgattctgaccaacacagacctgatgaaaatccgcaatatgaaagtagacggatttaaggtagaaaccattccgattatttattataagaataccagtcttgagaaagccgtagatcgtctctttattgaggcggatcgtgcatacagagacggagccaatatcctgatcctttccgacagaggcgtggatgataaccatgtggcaattccttccctgcttgccgtatctgcattgcagcagtatctggtaaagacaaagaaacgtacttccctttccctgattctcgaatccggagagccgcgtgaggtacatcattttgcaacactgcttggttttggtgcgagtgcaattaacccatacctggcactggataccgtaaaacagctgatcgacgagcacatgttagacaaagattattatgccgcagttgatgattataaccatgcaattatcaccggtattgtaaagattgcagccaagatgggtatttctacgatccagtcgtatcagggttccaagatttttgaggcacttggtattgataaagatgtcattgacaagtatttcaccaatacggtcagccgcatcggcggaatttccatcaaggatatcgagaatgatgtcaatacgcttcattccgcagcctatgatccgctgggacttgaaaccgatgtaacccttgacagcaaggggcgccacaagatgagaagcggagccgatgcgcatctgtacaatccggctaccatccatctgctgcagcagtctacccagcgtggagactatgagatgttcaagcagtatacgagtctggtagatgaagaagaaaagcatacgaacctgcgtggactgatggattttgagtacccgaagaagggtgtgaagcttgaggaagtggaaagcgtagattctattgtgacacgttttaagaccggagcgatgtcttacggttctatttcgaaggaagcacatgagacacttgccattgccatgaatcacttacacggtaaatcaaacactggtgaaggtggtgaggacaaggatcgtctgaccgtcggaccggacggaaagaaccgttgttccgcaatcaaacaggttgcatccggacgtttcggtgttaccagccgttatctgaccagtgcgcaggagatccagatcaaaatggcacagggagcaaagcctggtgaaggtggacatcttccgggtaagaaagtatatccatggattgccaggacaagactttccacaccgggtgtatctttgatctccccgccaccacatcacgatatttattccatcgaggatcttgaacagctgatctttgacttaaagaatgcaaaccgcgatgcaagaatttccgtaaaactggtttccgaggcaggtgtcggtaccgtagcagccggtgttgcaaaagccggtgcacaggttgtcctgatctccggatatgacggtggtacaggtgctgcgccaagcagttccatccacaacgcaggtcttccgtgggaacttggtctggcagagacgcatcagacactgattatgaacggactgcgtaataaagtaagaattgagacagacggaaagctgatgagtggtaaagacgtggccattgctgcatgtcttggcgcggaagagtttggttttgcaaccgctccgctggtaaccatgggctgtgtcatgatgcgtgtatgtaatctggatacctgtccggcaggtattgcaacccagaatccggagcttcgtaagcgtttcgcaggaaaaccggagtatgttgagaacttcatgcgctttatcgcagaagaacttcgggagtacatggcaaaacttggtgtccgcacagtggatgaactcgtcggacgaagcgatttcttaaaggttcgcggagatctgtccgagcgtgaagcaaagcttgacctgagcaatatcttaaataatccgtttgcaggaacaaagcagaaggttatttttgatccgaagcaggtatatgatttcgaactggataagaccaaagatatcacggagttcttaaaacagttaaagccggcacttgataagaagcagaagcgtatgatcgataccgaagtaacaaacgtaaaccgttcgcttggaacaatcttcggatcagagattacaaagaagtacgacgatacactggatgaggatactttcattattaaatgcagcggagccggcggacagagttttggtgcctttattccaaagggactgacactcgaactggtgggagattccaacgattatttcggaaagggactttccggcggaaagctgatcgtttatccaccggcaggagtaaacttcaaaaaggatgagaacatcattatcggtaacgtagcactgtacggtgcgacaagcggtaaggcattcatcaatggtgtggcaggagaacgtttctgtgtcagaaattccggagctactgctgttgttgagggtgtcggcgatcatggatgtgagtatatgacgggcggtcgtgttgttatccttggtaaaaccggaaagaactttgccgcaggtatgagcggtggtatcgcttatgtactggatgaggacaacgatctgtacatgcgtaccaacaagtctatggtgttcagtgaggaagtcaccaataaatatgacgtattagagctcaaagaaatgatcaaagaacatgttaccctgaccaattcggaaaaaggtaaggaaattctcgatcacttcagtgagtatctgccgaagtttaagaaagtcatcccatatgattataaccgtatgcagatggcaatcgttcagatggaagaaaaaggtctgaatgcagagcaggcacagattgaggcattttatgccagcacgagagcataaggagggaagaaacaatgggaaagccaacaggatttatggaatacgacagatgtgaggcgcgttcggtggaaccaaaggaacgaatcaaaaattttgatgaattccacatcttcctttccaaagaaaaacaaagagagcaggcagcgcgctgtatggattgcggtgtcccgttctgtcagtcgggtatgacagttgccggaatgacttccggctgcccgctgcacaatctggtaccggagtggaacgatctgctttataccggaaactatcagcaggcatataaccgtctgcacaagacaaataatttcccggagtttacctcccgtgtatgtccggctttgtgtgagaaggcatgtacctgtggacactggggagatccggtatctgtccgggacaatgagcatggaatcattgagacggcatacaaagaaggttatgccggaccacatattccaaaggttcgtaccggaaagaaagttgccatcatcggttccggtccttccggactggcagcagcagatcagctgaaccagagaggacatgaggttacggtatatgagagagatgaccgtgtcggcggacttctgatgtatggtattccgaatatgaagctcgaaaagcagatcattgaccgtaagatcaatgtcatgaaagaagagggcgtgaagtttatcacgggctgtaatgtcggtgtggatatcaagagtgcagaactgttgaaagagtatgacagagtcatcctctgctgtggagcaaagcatgcgcgtgatatcaaggcagcaggtcgtgatgcagaaggaatctattttgcagtcgattatctgtcacgcaacacaaagagccttttggattccaattttaaggacaacaaatttatttccgcaaagggaaaaaatgttgtgatcatcggtggcggtgataccggaaatgactgtgtgggaacggctatccgtcagggtgcaaagtctgtaacccagctggagatgatgccatgtccaccggcagagcgggcagcaaataacccatggccggagtggccgaaggtgttaaagaccgactatggccaggaagaagcgattgcatgtttcggtacagatccacgaatctatcagacaaccgtaaaggaattccataaggataagaacggcaagctgaatggtctgacaatcgtcagacttgagagcaaggtggatgagaagaccggacgcagaaatatggtggaagttgcaggttccgagaagaagattccggcagaacttgtactgatcgctgcaggattccttggaacagaggaatacattgcaaaggcattcggtgtagagctgaaccagagaacaaatgtagctacagagcctggaacatatgcaacaaatgtaaagaacgtatttgttgcgggagatatgcacagaggacagtcactggttgtctgggcaattcgtgagggccgcgaggtggcacatgacgtggatacaagtctgatgggatattcttatctgtccgtacagtaaaatagagacttatggctggtgcatagccatatgatttttgggagtcatctgaaacagatggctccttttttacctcttgtgggcttcacgcagttattcttatttttatcgcagtatatctggtggcaagcaaaatgcacatgatactttgaacacagcaatgcaggcggacatgtggaatgtaaaggtcagggcagcagtgatccggatgctccgtgtgtggaactgcagatctcaagcagttttggacagacttgtataatttttggataattctgcttgatattatgtacatttcgatgtagaattatagataaatagtatacgatacataggaggaaacgtatgcgtaagaattactttcaaaatgtgaaaattgcggataagctgaaaatggttatgaaagcaatttttgcaattttactggtgaacaatattctgtttgcaattttaatgcttgtatttggacatccggtatggattatcattcctgtcattgcagtagttggtatgccattgctttccaaaatgatcattcaggaactgacagaaaatattcttgaaccgttagaccagatagaaaaggccgcagatgacatggcacacggaaatctcgaaattgatatttcttatcagggggaagatgaactgggaaagcttgcagaaagtttccgcaatacatctttttatttaaggggtgttgtggacgatatcaatcagctccttacagagtttgcaaaaggaaactttgatgcgagatcccatgatattgaagcctatcagggaaatttcggtgaaattttaaagaaactggaagcgacagaaaataatctgagccagacgatcaaaaatgtacaggaatcttccaatcaggtatccgcaggagctgaccagctggcacagagtgcgcagggactggcagagggagctaccgatcaggcagcggcagtacagcagctgacatcttcggttgccgaggttgctacacatatcgaagaaaatacaaagtctacagacagtgtacatgaccaggcaaagcgggttgcaatcaaggcagacagcggaagtgcaaagatgaaagaactggtcgaagccatgcagcatatttcagagaccaccaatgatatccaggttgtcatcggaaagattgaaagcattgccagccagacaaacctgttgtctttaaatgcatccattgaggctgcgcgtgccggtgaagcaggaaaaggatttgcggttgttgcagaacagattaaaaaccttgcggaagagagtgcttcttcggcagaagaaacccgtgtcatgctgacaaacagtctgaatcaggtgggtgtcggaagctctgttgcagatgagacttcccagtttatgtcggaaatgatcgaacagctggatgcggttgttatggaggtggctaagatccgtcagatttctgatcagcaggcagaatcggtaaagcagatttccgctgctgttgagcaggtaaacggggttgtgcagtctaattctgctacttctgaagaagtatctgcaaccagtgaagaactttctgcatctgctgaaagtctggatgagatggtatctgattttgttcttcgcaaataagatacgaacagatgactggcacattgtacagatgaggtgattttatgccgtcgatcatggtgtatacggaagaaacattttattatacagacggaatccgtgttgttgcgcgggaagaatatatgcggccggatgttacggaactgagtttctaccggaaagaaggtttctggtttggatttgaagctccgtattctatttataccatgcagggaatccgggcattgattgagttgaaactcagacaatacgattgtacaccggaatttcgctatacgcgtaagaaaattgaatatagttacagtgaaaaaaagattctcgattccgtgattttttatatcacgaaatccgatcagccgggagttttgtctgtgatggaggaaattaatcattccactcatctgtgtttctggaacatgaaagtgccataccatgattttggggaaatccgtaaacataccgatgcggtattttacggaatgtttcaacaaaaagcgtaatagttcttgactttttcggcaaaagttctataatacattctcggtaatagaggatgtgtcgaatgaataaagagagagattatttttttgataatttgaaagcggtattgatattcttagtcgtgctgggacattttttgctccctatccacggagaaagtgttcttgtggtggtaaagcgcctgatctatgtatttcatatgccgctttttgtatttgtgtcaggttattttgcaaagaaaatatataaaaacgggcagtataattttaaaaaaatattgtatctgattaaggcgtacatcatatttgttattgcaattcagatagtatatgcactgtgtggattccgggatttctcagagattaattttttctcgcagagtggggcaccgtggtatctgtttgccatgattgtgtggtatcttaccattcctgtcatccggaagtacaaagagataccggtattaatcgtgacggttgcgctggccctgatcgccggatatttcaaaaatatcggcgattttttgtgcatgtcccgtattctggtatttggtccgttcttttatctgggatattatatggaacaaccggtgcttgaacgggcattgcgaccggtttaccggagagttgttgtaccggctgctgtggcaatctgtgcgggaattctggcgtttggctcaaagttaaaagatgagcttggcatggtctatgaaaacatttcctattatgaactggatgatgtgtgggaaggaccgtttgttcgtctggcactgatgattgccgcgtttctgatttcgtgggcgattatgttttttgtgccgcgtgggaaaacctgtctgtcagtgattggacagaatacgatgccggtatatatgctgcaccggatcctgcgggatatcctgatgtttgcaggaatctatgactatctcggagactggggatggtttgcgctgtttgttctgatttgtttgagtatctgcgtgatttacctgcttgttaatccaaaggtagtaaatcaggtaaataagattctgacactgtataccccgcggctgtggggcagaatacgccagaatcaggcgatataaaggaatcgtagattgacgtttcctcctatattttctaagcttagaaccagaaagatataggaggaatttttttatggatgcaaaaaagtttggagtactctggtattatggagaaatgtctgcacggatacttaatggtgtaacggcacagagtatgatagaagtaattcgtatttgacaattccaaaaaatgattatatagtggcagaaaagaacttttgttttcacagagaaaatacactgagggaggaacgtaataatgtacgaatttacgcaggattgtctgacgggcatcgaccagatcgatgaagagcaccgaaaactgttttcgctgatcaatgaagcggttgaactgccgaaggaagcacgcacaccacagacggtaaaaaatatactggaacatttaagtgattatgccgtaaaccattttgcacacgaagaagcctatatgcaggcacagaacgatccggaactgccgttgcagaaaaaagagcatcaggcatttgccgatcacgtaaaacttctggaaaagcagccactcaccggggagaatgcatcggcgatgctcgatgagattctgacctatctggtacgctggctgtaccggcatattttaagcagtgacatgatgatcgggaaaatgcagaaagaagatccgtttgtgtttaccgcgaaatattacacggggatcgagctggtggacaaggagcatcagagactgtttgagattatcggagaggtaaatgcactgatccataacgacctgcttcatgacaaatacgatgaaattgtacgtctgctggatgaactccgggaatataccaagtttcattttgaagatgaagaggcctatatgcagaaaatcaacagcccgatgctggaagcgcaaaagcgggcccatcaggcatttgtggacaagctgatgagtatcgatctggataagctggaagaaattgatgacaaccagcaggaatatctgcatgagctgatcgagttcctcggcggatggctgattaatcatattttaaagatggatacgcagattgcaaaaacagaacagtaattattatgtgcggtgaaaggattattttcaccgcattttaatatgtcaatttaatatgaaacttatatagaaaatacgttatcctttttaaaaatattctttataataaaagatagcgagattgagaaaaggaagtgtatttttatggcaacaatttttccaagggaacagaaggcaaaaatgctttttgaaaagattaaagagaatccgcaggcatgtgagcgtctgatggaaacgttttatgatgcgctcggagtgggcgatgattatgagggcaacggtctttctgcggagcagtttgcaaccgcactgtttcgttcttatgaggaaaaggatctgacggcgtttctgatggcaatctgccagaacagtatgtttgatctgctgcggaattcgtttctggctccgtttcgttttaatgctaatggtcagacaaatccctatatcctgacggatgaggatggaaaattaattccggatatcaaatttcatgtcagtgacaaaaattatgagcagttttttaaggtatttcaaaagagtgaacaggtgaagatgtatctggcatacggattccgtaaacggcattgttatgacagagataccatggaagcacaggaaatccgtatgggagagcatatcggagtgctacttgtctatgaaatgccggatacggtaaaaatacaggagacagaagcgcaggcatatgcggccatctgggatatcctgatggatctgcagaaatccctgccacgttcggtcgtttattacggacaggattccatggaaaataagggaaaccgttacgatgcacttggggtgtttttgccgatgtaccattttcggaaggcattggagaaaaacattgatattgcaaacaaaattgtattgatgcattaagaaagaggatgatgattcatgcaaaccactgcaatacctaaaaatcacatggatatcccatggcatgagtacagcggccatggaaattgtccgattacagaggcagacctgaccgaaaaagcttcaatcgtcggccgtgtcggcctgatgctgttatcctgtggaacgggagcctggcgtgtccgcagttccatgaatacgatttcacaaaatctcggaattacatgttcgacagatatcggtctgatgtcgattgaatatacctgttttgatggaacgagtggattttcccagtctctttgcctgaccaataccggagtcaacacatcaaaactgaaccggctggagcgttttatcggtgaattttcaaccgtagggaaaaccatgacgggcgaacagctccatgatcatctggatgagatcgaccggattcatggactctattccccggtggctttgggatttgccgcggcactggcatgcggcgcattcacatttttgcttggcggaggacccgtggaaatgctgtttgctttttgcggggcaggacttggaaactttgtccgctgcaaactgacaaagcatcatctgacactgtttctcgggattgtggcatccgttgcctcggcgtgcgttacctataccattctgcttcggatcgcagagctgattgccggggtttccctgcagcatgaggcgggatatatctgttccatgctttttatcattccgggctttccgtttattacaagtggaattgaccttgccaagctggatatgcgttccgggctggagaggctgacctatgcgatcattattattgttgttgcgaccattacggcatggctgatggcactgcttttgcatctgcatccggtggattttccggcgctttccatgtccgttcccatgcatatcatactgcgtctggtcttcagtttctgcggcgtgttcggattttcgattatgtttaacagtccgtggaaactggcggcaacggcagcactgatcggagcagtggccaacaccctccggctggagctggtggatcttgcttcatttcctccggctgcggctgcttttgtgggagcacttttggcaggaatccttgcatcattgatcaaaaaccaggcgggatatccaaggatttcacttacggttccgtcgattgtcattatggtaccgggactgtatctgtaccgggcaatttacaatctgggtgcgatgtctttgaatacctctgcatcctggtttgcttctgcaattttaattattgtggcactgccgcttggtctgatctttgcaagaattctgaccgaccggacattccggtattgtacatagaaatacgtctgtttccttacggctccacaaatcccggaaagatactgacacctctttattttagaaaagacttgcaaaaacagaccaattgaagtaagataagatacacaaaacaggatgtctgaaaaagactatagattttacggtttctgattcaaaccgtcggtctatagtctttttttgcggaacatccggcagaaaagaggagtttgtatgaatcaggagtacatgaaaacaagaaaaatcctgccgctggtgctttccatgtcacttcccatggtcatatccatggcagtgaatgcattgtataacattgtggacagttattttgtggcaaagatcagtgaagatgcgatgacggcgcttgcccttgtgtttccggtgcaaaatctcgtcaatgccattgttatcggatttgcgatcggaatcaatgcaagggtagccttttatctgggagcaaaagaggagaaactggcggatgagtcggcatccgtggggcttttgttaaatttgatccacggtctggtgctggcactgctttgttctgccattatgccatcgtttcttcggatgtttacaggcgatacacaggtgatcgcactggcatgcacgtattccacgcgggtatttgcgtttgcaccagtgatcggtctggaacttgcatatgaaaagatctttcaggcagtcgggcggatgaaggtgtcgatgatctgtatgatgctcggatgtgtaaccaatattattttagatccggttatgatctttggtctgggaccggtaccgaagcttggaattgcgggtgcggcttatgccacgggaatcggtcagtgtgtgacgctggcggggtatctgctgttttattttgcacgtccgatgcatgtaaaggtcaacgtcgcaaatatgaagacaaccggaagcgtaatgaaaaatatttataccatcggaattccggcaactttaaatcttgcacttccttccattcaggtgtccgcattaaatgcaatccttgcgccgtttccgggaagttatattctggtgctcggagtttattataaactgcagacatttatttatctgacggcaaacggaattgtgcagggaatccggccgctcgttggatataattatggagcgggagaatatgacagggtgaaaaagattacgcacacctccatgggattgatcgcactggttatggttatgggaatggcaatttcctgtgcaattccgcagcagctgatgggattgtttaccacaagccgcgcaacaatggaaatcggaggtgcggcactcagaatcatcagttttggattcgtggtatcctcggtttccgttacattttccggagtcctggagggactgggaaagggcatgccatcacttttgatttctcttgcgcgctatatcgttgtgatgctgccggtttcttttgcgctcagccggttgttacaggcatcgggcgtgtggtatggatttgccgttaccgagtatatcgtagcggttctttcctattatatatacaaattccatatgagagatataaaagggtaacaaaataaaaaaagtgtggtacaatagttatgatatggataagagaaaaggaataaggaggagtcggttatgccatactcaaacgccaccaaacaggcatttgcagatgctcttcgaaaactgttggaacagaaaccttttgcaaagatcagtgtatcacacatttgcgaagaatgcggaatgaaccgcaaaagtttttattatcattttaaagataaatatgatctggtcaactggatttttgacactgaaattacaaagattttttcagaagaagaatggaaaaatgccggctttacatgggatatactggaaaaaatctgtgagtatttttataaacaccggacattctattcgaaggtactgcagattgaggggcagaactcttttacagaacatttccgggatattttagtccctgtcaatcgtaaatttcttgcgatggtagaggaagaggaaaaaggagaacatgaggaattttatattcatttcttttcggatgcatttctggcagcactggtgagatggcttgaggacagggaatgtgtgtccccgcaggaatttagtgcactgttgcgttcgagtgtggaaatgattgcaaagtatgtgctgcagagtcagaaataagggcagaagtattctgtaatctggcaaaattcgacaaattttacccacattcgtgcatttgtccacttgaatttaagaagagaaaagatataatacttttcagattacacaaaaacatttctgtcatgttatggcgacagaatgaaaggaagttgagattatgaataaaatgtcattacagaagagtattcagaactttggaatcaagcaggccttaaagtatatggagaaagatccggaggagaatattccgaaactgatggatatggttgacaaatttgcaccggacggatggtatgaggcacagagaaatatgatccgtaaggtaatcaaagaaagaggaaactggtatcagttaattcttcgtatttaccagctggatccggaagtacgtaaagcattcttccagaatttcattttcaatgcaagtttaaagggaagtgcattacaggaacagcttgctgaagaaaacaactgtaacattccgtgggcaattctgttagaccctacctctgcatgtaatttacactgtaccggatgctgggcagcagagtatggccatcagctgaatctggatctggatacgattgattctatcgtacgtcagggtaaggagcttggtacctatatgtatatttatacaggtggagaaccactggtacgtaaaaaagacctgatcaagatctgtgagatgcatccggattgtgaattcctttctttcacaaacggtactttgattgatgaagagttctgccaggagatgcttcgtgtcaagaactttgttccggcgatcagtctggaaggattcgagacagcaaacgatggacgaagaggcgaaggtgtatttgataaagtacagcatgccatgagcctgttaaagagccatggtttaccatttggtatttccacctgctataccagaaagaatttagatgatgtaaccagcgaaaaattctttgatatgctggttgagagtggtgcattatttgtatggttcttccactatatgccggttggaaatgatgcagcagtggaacttctgcctacacctgagcagcgtgaggaaattttccatcgtatccgtaagttccgtcagacaaaggcaatatttagcatggatttccagaatgacgcacagtttgtcggcggatgtatcgccggtggacgaagatatttacatatcaatgccaagggtgatgtggagccatgcgtatttattcattattccaatgcaaatattcatgactgcagcctgctggatgctttaaagagcccattattccaggcatatcatgacaaccagccgtttaatgacaatatgcttcgtccgtgtccgatgcttgagaacccggataagcttggagagatggtaaaagagtcaaaggcagtaaataccgattatcagtcaccggagacaccggaacatctgaaagaaaaggctgctccttatgccgagaactggacacctacagcagaaaaactctggaacaaagaaaaagaaaagattgcagcaggaaaagccggcgtggaacagtaatgataagttttctcaataaggacagccggattgctgttgcataaagtgtgggactccgctatttatcggatgatagatggtgtgagtcctttttttatactcttttttgcacgccgtggtgactaaaaaaatacttgcaaattggaaaaatggggcataaaatacgtttttaaacaggaagacaaaattataaatcagttactaaggaggaaacaatgatgttaaagtgtttcaaaaattttgatgcaaagaaaaccggactttttgcagcaggtgtactgtttggtaccgcaggaatcaagattctttccagcaaggatgcaaagaaactttatacaaattgtacagcagccgtactccgtgcaaaggaagttgttttaaagaccgctacaaaggtacaggagaatgcagaggatatctatgcagaggctaagcagatcaacgaagaccgtgcagcaaaagaagaggaagtatttgacggtgaggaagtaaccgaagagacaactgccgaagagacagaaactaccgaagagacagcagaggcataaaaacgcatgaaagagatgttacgcaataagtaacatctcttttatcgaaagcaggttaaagatatgaaatttcaaatcagacatgagataagaggaagaatgagaattcacgtgatccagagccgtatgtcatttgcacaggcagatacattacagtattatctggaacagtgtgaatctgtgatttccgcaaaaattcaaaatcgtaccgaagatgtgaccatttgttatgaaggaagcaaagatgcaatccttgaagtgttaaaggcattttcgtatgaaaagacggatgttccggatacctatattaaaaattccggaagagaaatgaatcagcattactgggatcagctggtggagcagacgttctggcatttcggtaacaaactgtttctgccgttttccgttcgtgcagtaatcacaacggtgaaatccgtgaagtatatctggaaagggcttcagactctgtttcagggtaagatcgaggttccggtactggatgcaactgccattggtgtttccattatccgtggtgattttgcgaccgcaggatctgtgatgtatctgcttggtatcggagagacgctggaagaatggacacataagaaatccgtgggagatctggcacgcagtatgtcactcaacatcagcaaggtatggatgatgtgtgatggacaggaaatactcgtttccgcagacaacgtgcagtccggagatgaagtgcgcattcatatgggaaatgtgatcccgtttgacggaacggtaacggatggagaggcaatggtaaatcaggcatctttaaccggagaatcggttccggtccgcaaaggacctgatggtgtggtatatgccggaactgttgtcgaggaaggcgagattacgatccgcgtcagagaagtaaacggatcaagcaagtatgaaaagatcatggcgatgatcgaggaatcagagaaactgaaatcctcactggaaggaaaagccgaacatttagcagataaactggtgccatataccttcctgggaacagggcttgtatggctgtttaccagaaatgtgacaaaggcagtttctgtacttatggtagatttctcctgtgcactgaaacttgcaatgccattgtccgtgctctctgcaatccgggaagcaagtacctataacattaccgtaaagggaggcaagtatctggaagctatggcggaagcggataccatcgtctttgataagaccggtacactgaccaaggcacagccgacagtggcaaagattgtttccttcaatgatcagtccgaggatgaactgcttcgtattgctgcctgtttagaggaacattttccacattccatggcaaaggctgtggtacgtgaggcagtaaaccggaatctggtacatgaggaacttcactcaaaggtagagtacattgtcgcacatggtatttcttccaagatcggggagaaacatattgtgatcggaagctatcatttcgtatttgaggatgagaatgctacaattccggagggaaagaaagagatatttgagcagcttccagagcagtattcacacctgtatatggcgattgacggagtgcttgtggcagtgatctgcatcgaagatccacttcgtccggaagcggttgaggttattgcaaagttaaagaaactcggaatctccaaggttgttatgatgaccggagacagtgaccgcgtggcatctgcgattgcgaaaaaagtcggtgtggatgagtatcattccgaggtattgccggaagataaagcaagctttgttgaggcagaaaagaatgccggaagaaaggtgatcatggtcggtgacggtatcaatgattctccggcattgtctgcagcggatgtcggcattgccatcagtgatggtgcacagattgcacgtgagattgcagatgtgacggtgggggcagatgatctccatgagcttgttactttaaagaagatcagtaatgggctgatggagcggattcacagaaattaccgtctgattgtaggcattaacacctcattgatcgttcttggcgtggcaggggcatttccaccaaccacatcggcattgcttcacaacacgtccacacttctgatcagcttaaagagcatgaacaatctgctcgatgaaaaggaagaagtaacagaagaaaatgtagcagaagcatttgcataatggaaacaaaactgtctgattttcataaaataaaaagaatgagaataaggcaggaacaaaatgaaagaattatatcctggggatcagggaatctgggtacaatatctgcagctggcattgcagcgtgcaggacagcaggtgatgctggatggaatttttggacccaagacctgtgcagccgtggaaaaagtaatgggcagcagcggaaagtgtgcggtaaaagaagcacagtggaaccgtctactgccctttttacgtgggtatatcacacacgaggtaaaagcaggagatacctttttctccattgcaaaaatgcataacacaacgatggagcgagtgatgcatgcaaatcccggaacggatgcaggagcattacagattggaagtacggttgttgtaccattcagttttccgttggtttccggagaagttccatatacttccctgcttaccgggtggatcatcgagggcttgcaggcacgttatccctatctgcaggtgggaacgatcggaagaagtgttatgggaacacccctgtggtcgctgcagttgggaaatggtccggtagaggtggggtacaatgcttcctttcatgcaaatgagagtattaccacaccggtacttttaaagtttgtggagcggctgttagaggcatatgcagacgaacgtatgtatgaagaactgtacccggagcggctgtttgaagaatattgcctgtatcttgtaccattggttaatccggatggtgtggatctggtaaatgggcttttgacggaaggattttattatcgccgtgcggtccgcattgcgtccggattcccggatattccgtttccggacggatggaaggcaaatatccagggagttgatctgaatctgcagtttccggcaggatgggatatggcaaagaaaataaaatttgaacaggggtataaccgtccggcaccgagggattacgtgggacagacaccgctcagcgtcccggagagtattgccatgtttgattttacgagaaactatgatttttccctgatccttgcatatcacacacagggagaagtgatttactggaagtatctggatgaggaaccggaaggcgcccgccgcattgcggaatattttgcaaaagtgagcggttaccggatcgaggaaacaccggcggcgtccgggtatgccggatacaaagactggtttatcaatttttatgaccgtccgggatataccatcgaggcggggctgggagaaaatccgctgccgatggagcagttttcgaaaatttataaagacaatgtgggaatcctgcttggaggaatgacggaacttgaataaaaaatgaggattacctctggtaatcctcgtaaatttttttgatgtgattgtagattttacttccaatggtagtatcaaacgttttgaccaatgcattgtttaatgcaagtttattttcggattcttccaccgctttatagatggatgtgtatttgccggccgggagtttttcatcttttaattctgttcgtatttttttgcggattgcttccggaagttttttcttttccggcttctttttttccacaatttcttttgtctcttttacctctttcgtcgctttttttgattctttgggaacgtgatccgattttttcttctttttctttgtggaggttcccttttttaaagaaacatcctttggggtggaaggggaagcaatgcttggctggcggaaggcttcgatgtttcttccgcgccagaaatcgacaatactgtcaaacccggtatcctggctgatgatgtaaaccggacctttttcccctttcccgatcaggaatccaagataggtggccagctggaaatccagataatttttagctaccttgtgtgtttcaatatattcgatcaccgctttggacgccatcatttctacatgtgtttcaaaagggatggacttgatgctgtctccgtaaaaaatgacaacacggtcagatgcagagagtttttggatgtctgttacaccatcgttgtgtacattttcatagtctacaagataaatgcccataggtattgttcctcttttccttaagatgtatccattatacgtcaaattcgaagggatggcaagaagggggatagggttaagaaagggttaagaaagggtaaaggatagaggagcaggctggaaaacgaattctttatgctgaatgattggttgacggaggtgtggtgaaatgttataattattaaataacaagtttgatattgttggataattttcacaaaatcgaacggctttacgggaaggagaataaagttatgaagaacatgaaggtaaggaccaagctgaatctgattctggttctggtcattttacttgtggctctcgggagtgttgtttccgtcaaaaacatggaagatgtgaaagacaaagcactggaaacgatggatgcatcgtcccgccagagttatgatgattcgatcaaagagcaggtgggggtggtcatctcccttttgacagagataaacgaggaatataaggcaggaacgtataccctcgatgaagcaaaacagattgcggcagaggaagtgcgtcagatgcgttacggagaggctggttacttctggattgaccagtcagatggtacaaatgtggttctgcttggcagtgataccgaggggacgaaccgtatggataccaaggatgcaaacggatgccagatggtgaaagaaatcatacgtgtagcagtggaagacggtggaggatatacagattatgtattcccgaaagaaggagagacaaaaccttccccgaagcgttcctacagtgagtactttgaaccgtttgactgggtggtcggtaccggaaattatacggattatattgatactgccattgcaaagcaggacaaggtattttccagctatgccatgcaaaaggcaatcgccctgatcgcggtatgtattgtgatgcttgcggttgttgcagtacttatttttatgatcgcacaggatattacaaagtcgttaaagaaagttgtcgcagagattgaagtgattgcaggcggtaattttgctcgcaagatgcagacaaatatgatgaaacggaaggacgatttcggacagctggcaggaacgcttgagacaatgagggaatcagtatgcggattgcttgcacaggtaaaggcagaggcggcaaatattgatgccgttgtggaatcgatggataccaatatatcaaatctgaatggagaaatcgaggatgtatctgcgacaactgagcagcttgctgcaagtacggaagaaactgcagcatcggcagagcagattaacagtatgacccagcagattgacggtgcagcaaaagagattgcggtacgtgcacaggatggggctacagaagcagaagaaatccataagcgtgcagcacagacgaaggaaacaacggtggagaaccggcggaaaatccagacgatgctggaagaaatccggggaaggctggaacaggcacttaaagaggcaaaggttgtggaacagatcggtgtgcttgcagattctatccttgcgattaccggacagaccaatctgcttgctctgaatgcatccattgaggcagcacgcgcgggcgaggcaggaaagggatttgcagttgttgcagaggaaatccgggtactggcagaacagtccaaagatgccgtggcaaatattcaggctgtgacggaaaacgtggataatgcagtaggaaatctggcaaaggattccaatcatctgctggattttgtagatacggatattgtgaagagttttgacgattttgagaaaatggcagacgattataacatggatgcctctaaaattaacgatctggtatcggatttcagtgcgacttccgaagaactggtagcatctatttccaatattacagaggcgattgacggaattacctctgcatccaatgacagtgctgcaggtacaacaaatattgcacaaaaaaccgtttcgattgcaggcggatcggcagaagtcatgaaaggggttaagacagcggaagcttccgcagaagaactccgcaggaatgtaagcaactttgtgatcgaagaataagaaaataagaaatataaaagggaattttataaaggggaaagtggttcatggactgctttccctttttatctgttcacaaaatgaacacagagtttacattttttacacacgcaaaagcgatacactgtttccgtaaagggcattttgttgtccaaaaaagaaaaggagcatttcgctgtgattgagatcaataatcttgtaaaaaaatacggggatcatacggctgtcgatcatctgtcactcgttgtggagccggggaaaatttatggttttctggggccgaacggggccggcaaatcaacaacgatgaatatgataaccggatatctcggtgcgacaagcggagagattaaaattaacgggcatgacattttaaaggagccggaggaagcaaagaaatgtatcggttatctgccggaacttccgccactgtacatggatatgacggtaaaggagtatctggattttgtggcagatttaaaacagctggaaaaaagtctgcgtaaacgatatgtggaagaggcaatggaaacaaccggtacgacagaagtggcagggcgtatgatccgcaatctgtccaagggataccggcagcgtgtcgggtttgcacaggcgatcctggggtatccggagatcattatactcgatgagcctacggtaggactggacccgaaacagatcatagagatccgtgaactgattcggcatctgggagaaaaacatacggtgatcttaagctcccatattttgccggaaatttctgccgtgtgtgatcatgtgtttattatttccaaaggaaagcttgtagcgagcgactctacggagaatctggtaaatctgatgtcgggtgcacaggagattgaactgacggtgcggaccggtgccggggaagcagccggatacttacagggagaagaaaacattgcaagggttgagcaggcggatcatgataaaatccgtatttatgcaaagaaaggtgccgatgtgcgggaagaagtcttccggcagatggcagagcataacgttccggtgctggagatgaagaccgtgacgaaatctcttgaagatgtattccttgagattacccaggaaggaggtgcacagtaatgtttgctgtgttaaaaagagaattccggtcgtatttccagaatgtgatcggctggctgtttgtggccgcccttatggcactgttcggactgtatttttatgtgtataatctccggcagggatatccgtatctgtattatacgttaagtgccattacgattatttttatgattgcggtaccgatccttacgatgcgcagttttgcagaggatcggaaaaataaaacggatcagctgatgctgacagcaccggtaccggtggcaaaggttgtgctcggaaaatatctggcaatgcttgcggtgtttaccgtggatattgcagttttctgtgtgacaccgctcattttacgggcgtttggaacaattcccatgggcgagagctatattgccatactggcgttctggttatatggagcagcttccattgcggtaggtatgtttatttccgcattgacggaaagccaggtgattgcggcagttctgacgtttgtggtactgtttatcagttatatgatgcagagtctgacaggacttatttcatcggatgggaattggctgacaaagattttaaactgtctggatctgtatgcaccgtttgaaaaattccaggggggctgtctggacattacggcaatcctctattatgtaacggttattgtattatttaatttctttaccgtgcaggccattcagaaacggcgttggagcatcagcaaaaagacattttcgctcagcgttttttcaagcagttttattgtcgtagttttagctcttgccgtggttgccaacctggcagtcgatgcgctgccgacgagaattacctcggtggactgttcgtattctaaattgtattccattacaaaggatacgaaaaagaccatgaaaaaactgaaaagtgatgtgaccatctatgttctggcagcggaaaaaagcaaggacgcacagattgattccatgctggagcgttacaaagatctgtccgggcatatcagggtaaaatacgtcaatccgaagagtaaaccttatttttataaggactatacggacaatgcaccgaccagcaacagtctgatcgttgtcagtgacaagcgttcgaaagtgatagattattatgatatctatgattatcagtcaaacatggattattccacatattcctacaacaacgaactgaagggattcgatgcggaaggacagattacaagtgccatccagtatgtaacgatggatgcgaaccagctccctgtcgtataccagatcaccggacatgatgaggctgcaatcggaagtgcattttcggatgtcatcagcaaatccaatatgacattgtcttccgtggaactgttaaatgaagaaagtgttccgaaggatgcggcagcgattattatcaatgcaccgcagaaagattttaataaaaatgatgcacagaaagtaattgattatttgcaaaaaggcggaaaagcgattatcgtgggaatgtattccgagaccgagatgccgaattttgcatcgattctggatacttacggagtaagctttaccacagggccgatcgcggataatgatgcacagcattattacaatatgggaggtccgctgtatctgctaccaaatgtaaacagcagttcgtataccggaagtctttccggcggatatgtatatcttccgatttctctgggaatcaattatccgcagaacagcacgacggatgacacggagagtacagaggagagtaagacaacgtatacttctttactggatacttccgatgatgcggttgcaaagaacaatccaaacagtatgcaggattatggatacgaagacggagacgacaagggaccgtttagtgtcggactggcggtagaagataaagtcgatgatgatcacacgacgcagcttgtggtattcgcaagctcgtatgtattcagcgatgaggcaagtcagatgacgacaaacaatgaatcactgttttccgatgtgatcggaaatatgatcacagatacccagtcggccggcagcgtaattccggaaaaagagtacacgctcagtaatctgacagtaaatgcattacatgcggcacttctgggattgctggttaccattattcttccaatcctgttactggccggaggaattgtaatctttatggtaaggagaaagaaataaagaatgaaaaagcagaaaatacagatgcttgtggtggtcattcttctggtgatctgcgttgttgcttatatttttatcagcaaaaacgcagggaaactggattccacagagaatgacggaccaaatgcatccatgggaaatgtgacagaaagtgttttggagacggagactgagactgagacagaatctgtcttagctacagaaacaacagaaaaataattatttcttgtgcgtaagtttgtataggaacgtataagcccagatcagtaccgggatcacgaaggtggcaaagatagaagctttgaacattttcatggttccggtattgtctgtgatggcgcataccagtgtacttaggtacagaacaatcagtaaaatgatgccaatgatggcaagaatctgttttccttttttcatatgaacaacctccttggctaaatatgctatttgcaggaaacctgtaaaccgtaactttatgatacgggaaatggcaggtttcgtcaagaaagggcttggaaaatggcagacattttgttataataaacatacatgcatcaaggcatgtaaattcgtaagtgataaaggtggtataaaaatggctatattgcaggattggcagaaaattgcctacaatgagaacgcaagtcagggggaacttcagaaattctggcagagatatttcctgttagagaagggtgtgtatgagaaattattgacaaacccggatgaaaaagtagaaggaacggtaaaagaacttgctgataagtatggacttaccattctggagatggctggtttcttagacggaatcaatgacagtctggtaaaagacaatccaatcgaaacaatggatgaaaataccagggtaaatctcgttttcgataaggaaaagctgtacaagaacatggtagatgccaaggctgactggctttacaatcttccgatgtgggatgatatttttgataaagagacaaagcacagactgtatatggaacagaaaaaatccggtacggttatcgttggcaaaaaggtgggacgtaatgatccgtgtccatgcggcagtggaaagaaatacaaattctgctgtggaaagaataaataaatttcaaatttaaaaaaagaaattcccggtatcgcaaaagctgataccgggcttttttaaaaagaagaaccggaacagaataagaccatgtggtttggtacatactgatgtggcagcgatgatttaacacaaggaggtatgtaagatgacaaaactggattgtaatgtggtaaactgttcttataatgcagacaactgctgcagacgaacggatattcaggtggaaggaacacaggcaaaaacttcttccgaaacctgttgtggaagttttgcaccgaaaggaagtggatgtcagtcctgtcatacaacagatgtcaaaaaagatacaaccgtcagctgtgaagcgtgtgagtgcaaattcaacgaggatcatgcctgtcatgcgggacacattggtatttccggcggacatgcagacagcagcagggagacagagtgcggcagttttgtatgcagctgctgacaggggcatatgggcggcagactgccgccctgccagtgaaaggagaaaaggaatggaacaactaacggattacagtattaattttccgcatttacatatttatttgcaccatgtcggaaaaaatatcatgatcggaaatttttcggtggcatattatggaattgtgattgcaatcggaatgttagcaggacttggaatcgcctgttggatggcaaaacggacaggccagaaaacggatacttattttgacctggcactcgttgccattatctgttctgtcattggggcgcgggtttattatgtgatattccgttgggatctatacaaggacgatctgctgagtgtgttcaatctgcggcagggaggtctggcgatttacggaggcgtgattgcggcaatcattaccgtgtttgtgttttcacgggtacggaaactgtccatgggtctgctttgcgataccgcgggacttggtctggtcttaggacaggttatcggccggtggggaaatttttttaacagggaggcatttggcggttatacggacgggttgtttgccatgcagctgccgctttctgctgtccgatcctcagatgtgacggacagcctgctgcagcacgtggtggaagtaaatggtatctcttatatccaggtacatcccacgtttctctatgaatccttgtggaatctgattcttttgatccttctgatcctgtttaccagacacaagcggtttgatggggaagtctttttgctgtatctggcagggtatgggattggcaggttctggatagaatccctgcggacggaccagctgctgctgccggtcatcggatatccggtgtctatggcacttgcagcacttcttgtggtcgtatcggtttcctggatcatcatctggcatgtccgccagcacaaaaaaacagcataatgtacatttggatgggaaaatcctccacacgtttccacgtgtggaggatttttttggaaaaaacggtagctgtcggctcattttcaagaaagacagggaataacccttgatttcagggggcttttagggtattatggatacatagtggtggaaagtggaataaaaaatccactttgtggtgtaaagtggtgaacaaacagaagttcagaaaatgaggaaggggaggtgagtctgccatgtttatgggcgaatacaatcattcggttgatgcaaaaggcagactgatcgtaccttctaaattccgggaacagcttggcaatgaatttgttgtgacaaagggactggatggatgcctgtttgtttattcccaggaagaatggaaacggattgaggagagtcttcgtgaaaaaccactgacttcaaaagatgcaagaaagtttatgcgattcttttttgcaggagctgcaaactgcgaagtagacaagcagggaagaattttacttccggcgaatctgagggaatacgcaggaattgataaagaagttgtttccgtcggcgtatttagccgtgtggagatctggagcaaagaacggtatctggaaaacaacgattttgatgacatggatgagatcgcagagcatatggcagagttgggaattggaatctaaatatggagtttaaacattattccgttcttttgaacgagacaattgaacaattacatattcgcccggatggcatttatgtggatggaacgcttgggggaggcggacattcactggaaatatgcagacatctgacaaccggaagactcatcggaatcgaccaggatgcagatgccattgccgctgccacagagagactgaaagattatgcagacagggttaccatcgtaagaagcaattatgcacagatggcggacgtgttgaagaatctcggaatcgaaaaagtggatggaatcattctcgatctgggagtttcttctttccagctggatacaccggaacgcggttttacctaccggagtgaggatgcaccgctggatatgcggatggacaagcgtcagcgcctgaccgcaagggacattgtgaacgattacagtgaagcggaactgttccgcataattcgtgattatggagaggatcggttcgcaaagaatattgcaaagcatattgtacaggcgcggaaagaaaaaccgattgaaacgaccggggaactcaacgcaatcatccgtggagccatcccgatgaaagtacaggtgaccggaggacatccttccaagcggacgtatcaggcaatccgcattgagctgaatcatgaacttgatgtacttcgcgatacgttagataccatgattgatttgttgaatgatgggggaagaatctgtattatcacatttcattcactggaagaccgtattgtaaaatccaacttcaaaaagaacgaaaatccgtgtacatgcccgagcaatttcccggtctgtgtatgtggaaagaaatccaaaggacgtgtggtgacaagaaagcccgttctgccttcggagaaggaactcgaagagaacagcagatcaaagagtgcaaaattacgcgtgtttgagcgtgtggaagatggaatggaaagcagggaagcgttatgagcagtaaaaactattatgtaaacgggaataccgtgagagaactggatacaccggttcgacacaatcagagaacacgcaaagaaatcgaagaggcaagacgccgcaaaaaccgtagaaatgcagcgagaaggaatcgccagagagcgatggagatgagccgcggttatgtggtatttcttacggcatgtgtagtgatcactgcactgactgccgttttgtttgtacagatgcagtcacagatgacgacacgaatgaaaaatgtggcaaatctggagagccagctggcagatcttcgcgcggacaatgatgcacgttataaaaatcttacaacttcaacagaccttgaacatatcaaaaaagtggcaatgaaaaagcttggcatgaaatatccaacggaaaaacaggtggtatattataccgtggaaaacagcaatttcatggatcagtatgaggatattccatccaaataacaggagtcagatgtgagaagaaagagaagaagaccggcacagaaatttaaccggaagatgcggacaaaactgatggttttgttttcccttattctggctgttttgtgtggactggtcggcagattgacttatattgaacacacgaaaggggaaacctatcagaaaaaagtactttccatgcagtcctatgacagtaaaacgattccgtaccagaggggagaaatcatcgaccgttccggtacggttcttgctaccagtgtggcagtctataatgtgattttagactgtaccgttgtcaatgacaaagaagagtatgttgatccgaccgtggaagcactggtgaaatgtttcccggaattggatgaaacggagatccgcagaattataaaagagaaaaaggataaacgctatattgtacttgccaagaaagtgccatatgacgaagtacagccttttgtggaactgcaggatgccgtagacaaaaagggaaacaaagtgaacccggatatcaagggtgtctggtttgaaaaagaatatcagaggaattatccgtttggatctttagcctcttccgtgattggttttacttcttccgggaatgtcggcacaaccggactggagaattattacaacagtacattaaacggaatcaatgggcgggagtacggttatctggactcggacagcgattttgaaaagaccgtcattgatgcacaggacggggatacgctggtgacatccatcgacgcaaatatccagtccatcgttgaagaaaaaatcaaagactggaatgaaaaataccgggacaactattataaaggaaccggaagtatcaatacggcagcgattgtcatgaatccaaacaatggagaaatccttgccatggcagattatccgaatgtggatctgaataacccgagggatctgggaaaatggtacaccaaaaaacagatcaagcgcatgtctgaggatgacaaaatggatgcactcaatgaattatggcagaatttctgtgtgacttcaacgtatgaaccggggtctgtccaaaaaccgtttacggtggcatgtgggctggagacaggtacaatcaacaacaaaatgacatttgattgtgatgggtacgaggattttaatggacagaaggtgcgctgcgtggcgcgctacggacatggaatagaaaccgtccggaagacacttatggattcctgtaatgatgccatcatgcagatgtcatacaaaatcggaaagaatcattttacagagtaccagtccatctatggatttggacagaaaacgggaattgatctgccgggagaggcaaataccgcatctttgatgtatcaggtggaagatatgaaaccgatcgatctggcaaccaatgcattcggacagaactataactgtacgatggtccagatggtgagtggatttgcgtcactgatcaatggcggaacttattatcagccgcatctggtaaccaaaatcacggattcgacaggaaatacgatttccacggtggaaccgaaagctgtgaaacagaccatttcccagagtaccagcgataaaatccgggattatctgcagagtgtcgtaaaggaaggtacgggaaatacggcaaaagtggatggatattctatgggcggtaaaacaggaaccgcacagaagtttccgcgtggaaacggaaaatatcttgtttcatttatgggatttgccccatacgacaacccgcaggtactgatctatgtggttgtgaatgaaccaaatgtggcagaccagccgcacagcgtgtttgcgcagaacattgcgcgtgagatcttagaagaagttcttccgtatatgaatatttatccggatgaaaagaagaccggtgtaaacaagggctatgatgttaccgggtcaaaagacagttcacagtataccggaaagcataacggaaccaagtccagaaatgaaaagaaaaagaagaaataaagacagagagttcttagaaaggctctgcagtgcatatgctttaagaaaaggatcgtggtgcttttcatggagtggaataaaacctatcaccgcagaaaaatatgtatcatattcttttctgttgttctgatgtcgatggttttgtgcgggcgtctggtctatcttatgctttttgagggaaaatattatgagacgcaggcaaaagatctgcagcagagagaaagaaaaataaaagccgccagaggcaaaattctggatcgaaatggtgtagtactggcagataacaaatcagtctgcaccatttctgtcatacataaccagataaaggaaccggaagcggtcattgccatgctcgtaaaggagcttggaattccggaagaaaaggtccgtaagcgggtagaaaaatattcgtctctcgagaagatcaaaagtaatgtcgataaggaaaccggaaaccggattcttgcctatggctatgcaggggtgaaagtggatgaggattataaacggaattatccatacgatacgcttgcctcaaaagtgctggggtttaccggcggggataaccagggaattatcggattggaaagtgtgtacgacaaatatctggagggaaccgatggtctgattctgacgacaacggatgcccgcggtgtggaagttgacaatatcggagaggaacgcaaagaacctgttgccggaaataatctgcgcacatcattggatgcaaatattcagatgtttgccatgcaggcggcaaataaagcatatattcagaaagaagcggattctgtcagtattattgtgatgaatccttccgacggagccgtcatggcaatggtggattatccggaatttcatctgaatgagccgtttcagctgattgaggagtataaggagtatgagggtaccaaaaaggagcaggaatactgtaaccggatgtggcgaaaccagtgtatcaatgatacctatgagcccggatcaacatttaaggtgatcaccgcggcagcggcactggaagaaggtgtggtttctttggaagaccggtttcactgtccgggatatatcgtggtggaggaccgcaggattcgctgtcacaaaacgaccgggcatggagcagaaagctttgtggaaggaatcgaaaattcctgcaatcccgtgtttatcaatgtgggacttcggatcggtgccgatcacttttatgactattttgagcagttcggtctgttacataaaacggggattgacctgccgggagaggcttcgaccatcatgcacaagcgggaaaagatcgggcttgtggaactggcaaccatctcattcggacagtcatttcagatcacaccgatccagctggcaaccaccgtttcttctattattaatggaggaaaccgcgtgacaccgcacgtcggaatgcaggtggagaatggagacaaaaaagtaataaaaacgtttgattttccagcgcaagagggaatctgcagggaggaaacgtcggaaaaaatgcggtttttgctggaaaaagtggtatccgagggaggcggaaacaaagcatatattgaggggtatgagattggcggaaaaacagccacttcacagaccctgccccgttccgcacataagtacatctcctcgtttctggggtttgcaccggcggatgatccgaaagttctggtacttgtgatcataaggaacccttccggcatttattatggcggtaccattgcggctccggtggcaaaggaaattttcgaaaacatactgccttaccttgaattggagcagtaaataccttataatcgtaattatacgcaaagatggaggttgatcgtaatgaaacttgaaggaaaaaaggttctggttgtgggagccggaaagagcggcattgctgcgtcagaactgttattggataaaaaaattgaaactgttctctatgatggaaacaaagatctggatgtagaaaagttatatgaaaaggcaccgaagctgaaagggatgccggtgcttttgggggaactgacggatgagcagctgcgggcatttgatgtagcagtcttaagtccgggtgtcccgacggatctgccggtcgtagagcggatgcgtgcacagaacgtctgtatctggggcgagattgaacttgcatattccttcgcaaaaggcagactgattgcaatcaccggaacaaacggaaagaccactacgacagcattgaccggagaaatcatgaaaaattatttcaaggatgtgcgcgtggttggaaatatcggaattccgtatacttccgaggctgccacaatgacggatgaaaccgtaaccgtcgcagagatcagcagtttccagctggaaaccattcatgagttccatccggaaatatccgcaatcttaaatattacgccggatcatctgaaccgccatcatacgatggagtgttatatccggaccaaagaggcgattaccaccaaccagacaaacgatgaggtctgtgtactcaattatgaggatgaggtgcttcgggcattcggagagagcgcaccggtgcatgtggtctggttcagcagtgcaagaaaactggctgaaggattttatctcgacggagaggaaatcttttatgcgcatgacggaagcaccgagaaggtgatcaatgtcaatgatctgaatctgctgggacgacataactatgaaaatgtcatggccgcaactgccatgagtgtgaatttcggagtgccgatggagaaaatcgtggaggtgctgaagcgtttccaggcggtagaacaccggatcgagtatgtgaccgaaaaaagaggggtccgtttttacaacgattccaagggaaccaacccggatgccgctattcagggaatccgtgcgatgaaccgtccaacgcttctgatcggaggcggttatgataagcagtccacatatgatgagtggattgatgcatttgacggaaaagtaaaaaaactggtgctgatcggacagacagcagaaaagattgaagtgtgtgcgcataagcatggttttatggataccgtgcgctgtgagacctttgaggaagcgatccgttactgctatgaccatgcagtatccggggatgcggttctgctttcaccggcatgtgccagctggggcatgttcccgaactatgaggagcgtggccggatattcaaagaaatcgttcgtggattagaggagtagtgagtcgtgccgaaacggagacgtggggaaaagaaaacaacatattttgactataatctgttgtttatcattattttcctattgtgttttggactggtgatgctttacagttccagttcgtatacatcagcaaataaatatggggacagtgcacattatctgaaactgcaggcgcgaaatatcgcaatcggtcttgtttttatgttctattttgcaaagaaggattatcatgtgtggagaaaattcggaaggctggcatactggggagccctggggttttgccttgtcgttctggcaaaggtaccggggctgacgcgaagctcccacggacagtcccgctggattcaggtcggaccgatcggctttcagccatcggagcttgcaaagattgccatcattatttatctggcgatgctgatcgagcgtattcccaagcagctggataaggtttcaagcatggcaaaagtaggaatccgtctggtgccgcttgttttgtttgtcgcggtaaacaacctgagtacggcgattatcattcttgggattgctgtctgtatgctgtttgtggcaagtccgaagtacaaagagttttttgtggttgccgtgctgggggtgctgtttattttcgcatttatcaatatcgcgtcttaccggagtgaccgtgtggaggcatggaaacatccggagacagcgggagataagggatatcagaccatgcaggcactctatgcaatcggatccggcaagctgtttggaaaaggactcggacagagcctgcagaagctgggcaatgtgccggaggcacagaatgatatgattttttccattatctgtgaggaactcggtcttttcggagctgtctgtgtcattcttctgtttgtcctgatgctctggcggatgatggtcattgccaataatgcaaaggatctgtacggggcacttctggtgacgggcattatgtcacatattgcgattcaggtagttttaaatattgcggttgttaccaatacgattccgaataccggtgtcattctgccgtttatcagttacggaggtacctcgcttgtattccttatggcagagatggggcttgcgttgagcgtgtcgaagggcatccgtctggatacgatcgagtaggtttgtcatgattaaagaagaacgaagaaaaaagaaaaaaagaaaaaatatcctgcagggaatactcggaatcctgatagtgcttgcgctggcagtcctgatcatttttaccgtttttaaagtaaaaaatgtggaggtggagggaaacaaactctacgatgccaaagtgattgaaaaagcagtattaaacgatgagtattcctggaattccctgtatgtattcctgaaatataaatttgtcaataccagtgaagttccgtttgtggacacgatggagatcagcctgaaagatccgcagacgctgcatatcaaagtgtatgagaaaggaatcatgggatatctgtatctctcctcgatcaataagaatgtctatttcgacaaagacggcattgtgacagaattgtctgaccgtgtgattgaggatacaccgcagatccttgggattgactgtaaaaaagtagtgcagtatgaaaagctgccgatcggctcgaagcggctaaagcagcttctgacgctgacgcaggctttaaaacgcaatgacctgatcccggattccattacctatggtgtggaaaatgagccggttctgacatacgggacggttaaagtttccatgggttccctggaatttctgacccagaaagtggagcggctggcaaaaatcaagccgcagctgcagggaatggaaggaacactacatttagaaaactggacagaagaaacgacaaatattgtgtttgacaaaacggaaagttcgaaaaaagataataaaaaatcataattttcggttgattatttgtatgaaaaattatattatagtctatatgagtacgtatgaaacatttttatgtttcacggtgccgcagggctataggaaagaggaggaagaaccatgctggagattcggacaacagagacagatacgagtgccaaaattatcgtgattggtgtaggtggtgctggtaataacgctgtgaaccgcatgattgatgagaatataggtggagtcgaatttatcggagtaaatacagataagcaggcgttgcagctttgcaaggctcctacgttgatacagatcggagaaaagcttacaaaaggacttggtgcaggagcacagccggagatcggcgagaaagcagcagaggaaagtgcagaagaattatccgctgcagtcaagggtgcagatatggtattcgttacctgtggtatgggtggcggtaccggtaccggtgcagcaccggtcgttgcaaagattgccaaggagcagggaatcctgaccgttggagttgtgacaaagccatttaagtttgaggcaaagaaacgtatgatcaatgccgtatccggtattgaaaaactcaaagagagcgtagataccctgatcgttattccaaatgataaacttctggagatcgttgacagacgcacttccatgccggatgcattaaagaaagcagacgaagtattacagcaggcagtacagggaatcacagatctgatcaatctgccggcacttatcaatctggattttgccgatgtgcagaccgttatgaaggacaagggtatggcacatatcggtatcggtaatgccaagggcgatgagaaagcaatcgaggcagtgaaacttgccgttgcatctccgcttcttgagacaaccatcaatggtgcaagccatgtaatcatcaatatttccggtgatatttccctgatggatgcaaatgatgcagcaagctatgtacaggatctggcaggagaagatgcaaatatcatctttggtgcaaagtatgatgagaccatgacagatgaagctacgatcactgtaattgcaaccggattggagaatccatccatgaagatgaagccacagcagcaggcgggtggaatcggtggccgtatggtatatccgaatacaaacaatgtccgtccgacaggttccgttggaattgtcagccgtgcagctgcttctggaaacaatagttttccgggggtcaataacagcaattatgtcaatacaggtaccggtgtgggaagcagaccagtcaatcagccgcaggcaccgactccttccgcttcgaactattccggaatccagcgtccgaagccggtagagagtaatgtaaagccggtagaaattaatattccggatttcctgaagaaccctagaagataaaatcgcacaatatgtcgataatttccaaataacaacctcttgtttttgccaaattatgaggaatatttttcttataataggagcagagacaggaggtgattttttatatatgtattctatattgatatctttctgaaacaaaactttctgatgaattttcttgtattatcccttacctgtgtattttgcaaaagtgcagtctgtcaccggaatctgcgcatgttagctgcggcggtttccggcacgggacttgaagcgtttggactgatggtgctgccttatgcaatttccgttctgtgtactgccatcggcatcgtgccgcttatggtttttcttgcgtttggcagggaaaataaaaaacagaggatggtgagggttttaagcagctggttgtccattgtattgttaaacggagtggcaactgcagtttacaatctgacgggactggaaaatctgtatctgtataccgcattggcaacggccggaatcacttacgtacttgtcaaaaatcttgtggtgtcggtgcagaggcaaaagcgacagatgtctgtggttctgtataacaaaacggtgtcggttccatgtatcggactgctggattccggcaatcttttaaccatgccattaagtgggaatccggtacatattgcagatgcagccctgctgcagaagcttgtcgatgaaaaaacggtacaaaaggagattccataccgtgcactcggaaatccgcatggaaaattgcaggtgtactgcatggatgggatgaaagtagagacggagccggcaaaattctgtgactggaaacaggtatgggttggctgcgcggaaaatggggtgctgtgcaataaaccgtatcagctgattctgcatgcatcggtggcagaccactgtggctgcacaaaagatccatcccaaatgacaaaaaaactgagaaaggagaaacgtaatgttttcactgtttgaactggtgtggaagagaatccgcctgttttttacggatgatgaggttttttacataggaggggcagatgtactgccaccacctttggagcgggaacaggagaaccgctgtcttattgctttaagcgggctgcatggggacagtgaacccatgacgcgcgaagacgcaagaaagcagctgatcgaacacaatctgcgtctggtggtatatctggcacggaaatttgaaaataccggaatctgtgtggaggatctgatctccatcggaacgattgggctgatcaagggaatcaatacatttaatccggaaaagaagatcaaactggcgacttatgcgtcccggtgtatcgaaaatgagattcttatgtatctgcgcagaaataataaagtgaagctggaggtatcaattgatgagccgttgaatgtggactgggatggaaacgaacttcttctttcggatattcttggaaccgatgaagatatcatttaccgggatatggagaatgaggcggagatcatgcttctccgcactgcggttaatacgctgactccgcgggaaaaagaaattatctgtctgcgctatggaatcggaagaaaagacggcagggaaatgacccagaaagaagtggcagacctgcttggaatttcgcaatcctatatttcgagactggagaaaaaaattatggtgcggctgaaaaaatcaattcaaaataatgtgtaagtgtgctatactaattacataaaatttgctctgaaatagtaaaatttatatgcaaaataacaaggacagcaggatgaaagggcgtggtttttatgaagattgaatttttaggggcagaccgtgaggtgacgggaagctgccattatgtggcatttggggagactcattttctggtggactgtggtatggaacagggggcggatctgtatgtgaatcaggagataccggttaacccggcaacgattgattatgtgtttgtgacgcatgcccatattgatcattccggacttcttccacttttgtataatcacgggttccggggaaagatttttgcaacaacggcaacctgtgaactgtgtaatatcatgctgaaggattcggcacatattcaggaatttgaggcagaatggaaaaaccgcaaggcgcggcgtgcaggaaggccggaagtgacaccgatgtataacatggaggatgcgcagggggttttagagcatttcgttccgtgtacataccatgaaacggtgcagatctgcgagggactgaccataaggtttgtcgatgcggggcatctgcttggctcctcctccattgaaatatgggtgactgaggatggcgagacaagaaaacttgtcttttccggggatattggaaactacaaccgtccattgatccgtgatccggaatatcttgaggaagcggactatgtgatcatggaatccacttatggaaaccgcaatcacaatacaccgccggattatgcggcagaactggcaaaggtgatgaattccacgtttaccaaaggcggaaatctggtcattccggcattttctgtcggcaggacgcaggaaatgctttactatatgcgccggatcaaaaccgaggggctgctgccggagtatccgggatttgaagtatatatcgacagtccgcttgccgtggaggcaacaaatatttttcataagagtgtggaagagtgctttgatgaggaagcaagacagctggtacagtcgggcatcaacccgatccagtttccggggctgaaagtggcagtttccagtgaagaatccaagatgatcaatttcaaccagaaatccaaagtgattatctcggcttccggcatgtgcgaagccggccgtatccggcatcatttgaaacacaacctgtggcggacggattctacgattctgtttgtcggttatcaggtgccgggaacgctgggctattctctgttaaacggagtaaaaaaggtaaaacttttcggagaggaaattgaggtcagagcaagcatcgtaaaccttccgggtatcagcgggcatgcggacagggatcatctgactgcatggattgcaaactttaagaagccgccgaagaaagtgtttattgtacatggcgaggaaaccaccgcggtagagtttgcggaacatgtcaaaaacgatgtgggatttgatgctttagctccatatagcggggatgcgtatgatctgcttaccggagaacagatcgcacagggaagcagacagcttgtggagaaaaagacacagggtgtttaccgtgcaaaatccggcgcgtttgaccgcctgatgattgcgggagaacgtctcattgccgttattaaaaaatgtcagggcatggcgaataaagatcttggaaagtttgcggatcagatcaattcgctctgcgataagtgggaccggtaaatttgaggggaaagcgggacttaagtcccgcttttcccatgtccggaacaaccggatgaaaatgaataaaaaaacagcacatgggaatcctttattataaatccaattataacggaggaatcccatgtctacgtacaaagttgaaatctgcggggtaaatacggcccagctgccaatactgaaagaagaagaaaaagatgaacttttcaaaaagataaaagccggcgacaaggcatccagagaaacctatatcaaaggaaatctccggctggtattatccgtgatcaaacggtttaataatcataatgaaaatgtggacgatttgttccagattggctgtatcggactgatgaaggcaatagataattttgatacgagtgtcggggtgaaattctccacatatgccgttccgatgattatcggtgaaatccgccggtatctgcgggataacagcagttaccgcattccgcgttcactgcgtgatattgcatataaagccatgcaggcaaaggaacggctggcaaaaaatgcgcagaaggaaccgactctcgaagagattgcagccgaatgtgagattccggtggaagatgtggtctatgcactggatgccatccagacacctttgagtctgtttgatccggtttatacggatggaggggacaccctgtatgtgatggatcagatttcggacaagaaaaacaaagaagagcactgggtggaggatttgtcactttccgatgccctgtcacatctgaatgaacgggatgagcatatcatccgtctgcgtttttttgagggaaagacacagattgaagtcgcggatgaaattcatatttcacaggcgcaggtgtcgcggctggagaaaaatgcgttaaagagtatgcaggggtatctgcgtacatgatagcggcctgttgtaaaatggttttgttattgctataatgtggaatatacaaaacggagaggaaaagaaatatccggcagtagaaaattgcattcttgctttttgcggtgtactgtgctatactgtcaaccgttgcagagcctgtaaacaggggattgcacgaaaaattaccgagtgttcgagaccttccactcgtaaaacaaaactaaaggagacaaatggatatgagagacaaaaaggtaacatttattgttcaggctgctgtgattgcagcactttatgtagtgctgacttttgtagccaacgcactgggacttgcatcccacacgattcaggtacgcttttctgaagcactgtgtatcctgcctgtttttacgccggcagcgattccgggactgtggattggctgtctgcttgcgaatctgctgacaggtgccgtgatttatgatgtcattttcggaagcattgccacgctgctggcagcggtatgtacctatctgctgcgcaatcacaagattgcatgcacatttccaccggttatttttaatatgattattgttccgttcgtgctggtctatgcgtacggtattccggcagtatatttccacggtgtgaatgtaaccatcccgtttaatgccatgacggtcggaatcggagaggtgatttcagtatgcgttcttggaagcattctgatgcgtgtacttgcaaaatacagaaatgtcatgttccgtgccaccgcacaataaaaaattatatctgatagaaggttctggaagtccctgcgagagcaggggctttttattttaagaaattctgtaaataagccagacaattttaagaaaaccttaatgtcattccaaaataacgtatgttatcataaatgacaggaaaccgtaaagaacatttatggaaggagaagattatgaaaataagaaagacaatctgcagtctgcttctggtatgcctggcatttttaggcatattttgtggcagagcaaatgtatatgcagatcagaaacaggcattgtcggcaacggtgacactgctgaaacaggaaaaagactgtgtcgtgcaggtggaggccaaaaacagtggggcggattttaccgggaaggtgcggctggtgttttccggtaccgacaactccaacggctgcgcatttgaacagtgcctgacattgccgcagaacggaaaaaaacagtatacaatgaccattccgtatgcggatgtcagccagacacgcggaaacggaatcgtggcatttatcgatgaaaagggaaacgttgtggcaaaggaagcatttgccagtatttttggcaaagaaaagcgcggtattggtgtgggagtgctttcggatcattatgatgcgcttggatggatgagcatgagcggccagacctattatcttcacggaaaagaccagaatgtatatctgacacagatggacgcggatacattgcaggcgcagctggatgaactgtattttcttgtgattgattcctacgatgtgagttcacttggaaaagagaagatcaaggcaatcgagaaatgggtgaaaaacggtggatggctgctgattggaaccggagagcgcggcaaagatacactgggtggttttgattcctcatttatggaggtcagctgcaaaagcgtcagcaaagtgggagaagaaaatgaggtatcgaaagaaatgcagcaactgggaagttattccggatttaccgggattgatttttcacagatgccggttgcaaagctgcagcggaacaatacaaatgcaagcaaaagcgaagcttatccggggtgggtgtatgcctgtggggatggtgccatcggtgtatgtgccatttcttttggcgaaaaacagatgcagaaagtttccccggatctgtgttacggaatttatgaccaggtggcaggatattccatgagctattcccagtatgtcaatgacgaggaatggggatggagtggggaaaatgcattcggtgtcattgaccacctcaatacggcattggatttttcctggctgaaagttctgatagtggtctatgtgatcgttgttggaccggtgctttatcttctgctttgcaagatgaaaaaaagagactggtactggctgggggtaccggcgcttggcataatttttatcggtgtggtatttatcggcgggcggaatttaaagctgcatgagacacgggtttattcggtgaccgcacagcaggcagatggaaaaagtaccactggtatcgccacctattacaatgcgtatcattccggggtaaaaccgtggaaggtacggctgaatgataattacgcatatggtggtacaggtctcagtgaatcttatagtatggcatcttccggcagggtatatgaagaccgttatcactatttggtggaatatgacagggggctgtcccttggggtaaaaccgcagagcaattttgaaaatgcctatttgtttgcggcaggaactgccaaaggatgtggaagtatagacaccagaggtctggtgctcacgcagcagaaacaggggggaagcataacaaacaacacgtcctatgatttcccttatcttgtctgcgtgtcggatgatacggtcatggtattttcggatgtaaaagcaggtgagaccataacgatagacgggaaaagtaaaaaaccactgctgtcccagcagatttcttattttgatgatgtctacagcgtgttatcgcaagacaacatgaatggaaatacatattcgtataagcataaggatatggcagccgcactgtatctgggactgtgccagatccggcggaagaacgatgtgtcgggtactgttgtagtggaaggagtaaccgcagactacggaaaaaccatagagagcaggtgctcggaaatttcgtttggctgtctgtacacgattgccggtcaggaggtgtccaatgcttcaaattagtcatttgtataaaaactacggaaaatttcaggcggtcagggatctgaacctgcatgtgcccaaaggggatctgtttggctttgtgggaccaaacggagccggaaagacaacaacaatccggatggtatgcggacttatgccgccgacagaaggaaccattacgatccatggcgtggatgccctgctgcatccgaaggaaatcaaaaagcagatcggttatgtaccggatttctttggtgtgtatgacaatttaaaagtcagcgaatatatggatttttacggttccatgtaccgtatgacttccagggagatcaccgcggtatccaatgatctgctcgagctggtcaatctgtccgacaaaaaagaggtttatgtggatacgctttcccgcggaatgaagcagcggctgtgtgtggcacgggcactcatccacaatccttcccttctggtgctggatgaaccgaattccggtctggatccgcgtgcgcgtgtggagatgaaagaacttttgcagaatctgcgcagcatgggaaaaaccattgtgatcagttcccatattttgtcggagctggcagagatgtgcaacagcatcggtattatggatcacgggaaactcgtagaagcaggaaacatcgaggatgtcatggaacatgttttcggtggaaaccggatcgtggtttcggttcacggggagatggagccggcagtgcgcatgcttaaggaacacccccagattaaggtggaatcggtgggagaaaaggaaatccatatctcgcatgccatgaaagaggaagaaatcgcgcagttgatcgcacagatgatacagaatggaattatcgtgacaggattttataaagaagagggaaatctcgaatccctgtttatgcagctgacaggagggcaggaagatgagaattaatccaatggtaaaaaaagatattaaagtacaggcgcgcagtatgcggatctgttgggaaatatttgtttatgaggcgattatggcagttgtatttttctttgccatgtttttgttttcccagcagatgacctattcgtctgcaaacatatacagcagcattgtctggctgtatccggcacttgcggtcacgcagatttttattctgggagtggtagtcccggtgcgcacggcttctgcaatttcgggtgagaaagagcggcagacctttgatattatgatgacaaccagcatgaccggattttccattattatgggaaaggtgctcaccgcgatgatccagagcatgttttatgtggtggcaggacttccgattgtagcactggcatttgtcatcggcggactctcatggggcaacctgttctggtttctggcggtatcattactggtttcgttcgtttctgcaagtattggaattttgtgttcctccatctgtaaaaaaacgatcagtgccataattttatcgtatggtatctatgttctgctgtttatcggaagttttcttccctacctggtcacctcggttgtccgcatgtcaggtggtgtaccggaaaaatcctgctgggtgcttctggtcaatccgggcatgtatctgcttgaattttttacctggagtatgaccggaacatccgtggcggaagaactgattacaaattacgggaaaacactttctgtttcgggcactgccgtacattatggatggatggccgtttccacgcttttatttgtggcactggcatttgtctttcttctgattgcgatgcggcggatcaatccgatggcaggatatggaagaaaacatgcagggggaaagcagcatggatgaaaaagcatttctgctgcaggaaatccgttacagcaaaagaaaacagaacgtaaaaaagttcctgcgctatgaaagcacaggaattgccgcaggtggaaccatcgccatggtgctggaaggatgtgcggtgtttgtccctttttatacggtgcatgtgtgggctgttttggcagttttatgtggtgcggcagctggaggcatttatacggtaatgaagagatgtaccatggtacaggcagcacagcagatcgaccgtttcgggtttcaggaacggatcgtgacggcatatgggcgtattggaaaagagggcagtatcgaccggatgcagcgcagcgatgccgtgcatatgttacaggaagaccatgcatggaaaaaggcgcgtgtttgtccggaccgaaggaaacttgtggcactttttctttcccttgggctggcgcttgttctttcgtttgtgccgtcccccgcgcataaacaggcgcagcagcggcatgccatccggcaggaagcccgggaaaaggaaaaagaaatccaaaaagtgatggatgccttaaaacagactgacaccgcttccatgacaaaagaacaaaagaaagccctgcaggaactgatacagtcactggccttatcgcaaaaagaaatgcagcaggcagatacgaagcaggcactggcatctgccgggcagaaactttcctacaagtatggacaggcggcacagatttccggggcagatgtcctggcatcggtacttaaaaatatccaggtgaataccaatacaggaaaccagctggcacagggggatgtacaaagcactacacaaaacactacacaaagcggtacgcagcgtggggaatccacgcagtcttcggaaaccagttcccaggattccggggatggggaagattcgggcagtggaaaggacggaagtggaagtggcaatggaagtggaaacggaacaggcaaggggaaaggaagcggaaacggaagtggaacaggaaacggaacaggcagcggacgcggaaccggatccggagggggaacacatgattatgtgagtgttccgaataaactcggaaacgacagcagtatcacaaaggacaagggggattcgaagaattccgattattacaaggcgaagaatggtctggcatggaaaggcgaacacgtggatttagattccgtggtcggcgattacacgaaagaggcctacgaaggtattgccaatggaaaatacccggccggcatggaagatgtcatccggaattattttgaaaatctgaactgatggagaggagatcttatgacagaatatgaagtatgccagcagaacaccatggcatgtgaacaggaaattgcaaagggaattatcggacaaaaagacgtcatccgccaggtcatgctggcacttctggcgggcggaaatgtactcttagaaggtatgccgggactgggaaagaccatgctggtgcgcacgatcagccaggtgtgtgctctgagtttccagagaatccagtttaccccggatctgatgccgagtgacgtgaccggtaccaacatcatcgtaaaagaagagcaaaaaagtgcattccggtttgaaaaaggaccgatttttgccaatctggtgctggcggatgagatcaaccgtgccacgccaaagacacagtcagctctcttagaggccatgcaggaacacaccgtgacgatcggaacgaccagccatccgctgccggagccgtttctggtgcttgctacacaaaatccgatcgaaaacgagggaacttatccgctgccagaagcccagctggaccgttttttgtttaaagtgctggtaaaatttccggaccggcaggaactgcgggaaatcgtggaactgacggagggaaaccatccgccaaagatcgcaaaggtcatggaccgggaaagcctgcttgcagcgcgcgcatgcgttgcacagattccgattgcggatgccgtcatggattatattctggatctggttatggcaactcatgcagacaatccgtatattcgggagggggcaagcccgcgtgcggcacaggcactgatccgcacggccagggcacgcgcgtttatggaaaaccgcctgaatgtctcgtttgaggacgtcaaatgtgttgcacttccggtattgcggcacaggattctgctcagtttcgatgcagtatcggaggggattacggaagatgcggtgattgggcagatcttaacagaaaaggaacagggactgtatgcttgatgcgggaatttatgaacagctgtcgcggcttgtgatcgcgatgaaacagaaaagcagccagaatatggcaggaaaccgcagatccgtacagaaaggaacttctgcggaattttccgatttccgggagtatatgccgggagatgatctgcgcaggctggactggaatgtctatgcgcggtcggagcgcatgtatatccgggaatatttcgaagaaaaggaagcagtggtatcggttattttagataccagtgcatcaatgcactatggaaaaaagagcaaggcagaactggcacaggatctgtgcgcggtgattgcctttctgactttgcaccatatggacaggctggtgctgtatgatagcagccagatgggaaacccgcttgtggtttccgggggaaagaatgcactgccaaaagtacttggatggctgcaggcacgcacattttcggggacagagacggattctttttccgccgtgcgccagatgcagaggcgtggggcgggagttaccgtgatcgtcagtgatttcctgaccgaagcagcgacagatcccacgcaggattgtctggaaaaaacgatgcagtatctggactttacgaaacaaagaccagtgttgcttcagacactgtgtgcggaagaactgcgtgtgacaatggacggtacgcgcaatctgatagatatggagtccaaagaaaaattgcgcgtgacgatgcgtgcggatgtgattgcacgttatgaacgggaactgcaaaagctttctgtgcggctgaaaaaaagtgcatcggcggccggaggcacctatatactctgtgattccgaaaaagagagacgtgcgcttattttagaagatttaagacctttgtttgtctgagaaaaatttgaggatggattatgatatttgagagtttgtggccgctggcatttttgctggcgattccggttgttgtgattttatatctgcttgtgccaaaggggacagacacgccagtgtcttcgaacctgttgtggaagaagcttttttataatgaacagtctaaaacgttctgggaaaagtttttgcacaatctgctgatgtatctgcagatcgtgatccttttgctgcttattctggcactgatggcaccgtttgtacagcgtaagggtacaggcagtacggacgtggtgtatctgattgacaccagcggaagcatgaagcatctcaccaaagggggcaatacccgcctaggggaagccgtaagtgagatcaaagagcagattgccgcttcggatggggcaaaaatatccattgttacctgtgacggcacgggaaccaatctgcttgccgtccatacttccgagaaaaaagcactgtatcggacgctggcagacatcaagggcacggacacagccggatcgctttccgatgcactggcaaccgtacagactgtgcagaaaaaagacaaaaagaacgatctggcagatgtcatcgtctataccgacggcataggggcaaaacagacgaaaaatctcaaaagtcagcttcaggcaaccatccgcgtggtgggaagtcccgtttctaacgtggcgaatacgtttctgtcctgcaccaaagacagcagcggggacacgtatacggttgcatcaggcgtgacaaattacagcgatcatgcggcaaatatggagattacgctgtatgagggaaagaaaattcttgaagtgcgtacactttcccttgccgcagacgagacatatacctgcctgtttaaacaggtgaactggggaaaccagccgctgcataccgaactttccgcagtgacatttgcgggcagcagccagaaggattccttacatgaggataactgtgcctatgcactcaaagaccaggtttccacgagcaaagccacactgatcggggaaggaaatacctatatcgaaaaagcgtatcttgccgtgaccggagagaatctttccaaggcaaaaacaacggatgcacttgatagtgacgatccgggggtctgtatttttgatgcggatacggcagtgcaggaatctaatcagcagaaggcgcggatgatttttgccaaagagggaaagaacgaggaaaaaaatgtcagcctgtccgttggcgataccgaactgacttccggaatccgggactttgcgctcggggtaaatcagacgtatgtgtatgatctgccggtctgggccacgggctttctgtggaacggaaagcagtgcgccgcatactacggggagcatgacggaatccgggaggtggtacttggatttgacctgcgggaatcggattttgccctgcagccggagtttccggtatttatgaaccatgcgctgcactatcttgaggatagttcccttctttcccaaaacgtctatgatgccggagataccgtgcagtttcatgcattaaacggtgtggacgtgcagcagattgcagcacctaccggtcaggcaggactgtttaccgtaaaagcaggggacagaaaggaatcctatattgtaaaatttgcatgcagcagccagtcggatggacggatcacggcaggcgattccggaagccgcaacacgatgcagcggcagcttgtgcgaaagcagatgcgcaatgtcatccttatccttgtgcttcttcttatgatactggagtggatctgttatgtccggcagatgcgttaccgtgggcggttttatcttgcggtgcgtctggttgggcttgcccttttggtgctggctgtctgtggaatttcggtgccgctttcccacgcgaaagacacaaccgtttttctggttgatctgtcggagagcaatgccgcaaatctcacgcagatggagcagtatatgagccggcaggtcaaagacatgccaaagaacaatcagtatgccatcgtaacgtttggagccaatgcggttgtggaacagtttctgaccagtgagaaacacagttttcagattctctcggcaccggaggcggatgcaaccaaccttgaggaagccgtttccacaggactttccatgatcccggacaatgcggcaggacggcttgtggtgcttacggatggaaagcagacaaagggaaacatcgagcatacggcatcggcactgacggcaaaaaacgtgcagctgtattcggttctctatgaagatacaaagcaggggagcgatgcctatatcgaaaacgtggaaatgccggagtatctctatccgggtgattcctattccatgaccgtaactgtggaaagcaactatgagaccgatgcgaagctgcagcttttgcagggaacggagatggtcagtcagacaggcgtgcatttaaacaaaggcagcaaccgttttgttttgaaacagaaggtagtcggtaccgatgcgcagcagtataccgtgcgcgtgaaggcaccgaaggacacctgtgaaaaaaacaatgattatggtacgtatgcgacggtggattccctgccaaagattctgattgtatccggaatgggagaggacagcacaccgtttttaggacttttggatgctgccggatgcaattaccggcaggtatccgcagtcagtgcaccggatactttaaaagagatgctgcagtacaagagcatcattctggaaaatgtgtaccggacagatctgccggagggctttctaaaaaatctgaaaacttatgtgaaagactacggatgcggtctggtggcatgcggcggtgaggacagttttgcactgggcggatatctggatacggaactggagaaacttcttccggtcgatatgcagctgcgcggggtaaatgagaaacagaatctggcaatggtcatggtgattgatcattcgggcagtatgtcggaacagaccgaaggaggcaccaatctggatctggcgatcgcggctgccaaagcggctgtggatcagctggatacgaaagatgaagtcggtgtggtaacctttgatgatggttacacctggcaggtgccgctggaaaaagtgaaggataaagacaagatccatcaaagcatcgagacgatcagcgaaggcggtggaacgaccatcaaaccggccgtgcgtgcggcactaaatgaaatcaagaagagcaaggcgcagctaaagcatattgtccttctgacggatggacagggggaaaccggaaattttgaagatatcatcaaggactgcaaggatgccgatgtaactctttccacggtagcggttggagagtcgtctgacagacagcttctggaacgactggcaacgcagtgtaacggccgctattattattccgatatctcaaccgatatcccgaaaatctttgcacaggaagtatttttaaatggagatacgtatttgcagaacggacagttttcactgaaaggaaacagcagcaatgccatcacgaaaaatctctttgccgatggctggccgcagatcaaagggtacgtgagtgcctctccgaaaaccggagccaatgtgctgctggcatctgccgaaaaggatgacccgattttgtctgtcatgcagtatggactggggcatacggttgcgtggaataccgatgtgacaaaccgctggactgccgggctggcacagcagaatgattacgtgcagctgtggaagcggatcatcgattacagtgcgggaaatacagcactcggcgaagaccgtgtggacgtaactaccgtaaacggaacaacaaaagttacctattatgccaaagactacgcagagcagacacaggtggaggctgtgtacacggatccagatggaaaaacgcatcaggcgaaactgaccgcaagtgcgccgggaacttatgaggcacagctggatacggcagtctccggtgtctacaatctgagcgtgcagcggaaaaacggcaaaaaaatcgaaaatgccctgaccaccgcagccgtggtacagtattcgcaggagtacaaatttgcgctgacaaacgacagcttttgtgcgttcatcaaacagtatggaaagatgctttccccaaagaagaatgtatggaagaagttaaaagcttccgggcgggcacgggtttgtctgaccaatccgcttttaatccttttgcttttcgtatttctggcagatatcgccatgcggcggtttgcctatgttccaccaatgccacactggacgagaccggcaaaaaaagctataatgacaaaagaaaaaacagcagaagacgggcagccggagccggaagctgaaaaaccaaaggaaaagacaaagaaagcaaaaccggaggaaacggtttcccaggcactcgatacttctgcgctgttaaagaaaaaagaaaagcggaatcattccgtttaaaagaaaacaggagtcattatgcaatcagacagcaatttacgagaaacgttacggagtatcgatcataaaagttatccggcatacaaatccctgcggggaagttaccggtttgcagactatgtgttatccatcgatcatgtgcagggagatccttttgcggcaccttcccatgtgcgcgtgaccgtggatgcaaaggcagcggcatttccggaatatgccatgaaaaatacacggacgcgcacagcactggcagatgaactgctgcgcacgtttgccgcacagatcaaccactttacatttaaggcgaagggatcgggcaagagcggtctgatctcggtaacccactgcggacaggagattctgacccggacagcctgtgaagtgaacgaaaaagaaatcaccgcgcgttttgcggtaggatttccggcaaacggacggacgatcaatgccagggaactggagaaaattctgtttacctatctgccagaatgtgtaaagcattcattttattataagaatctcgatgcccgcagaatccgggatgccgtggaactggcagaagaccagcaggcagtccgtgaccagctgaaagaacaggggctggttgcttttgttgccgatgatgcggtactgccgcgggagagtgggatttcctcccggccgatgaaacagtccgtagcctttacctctccggaatcccttagggtgacgatgcaacttccgcacaggggtgcggtcaccggtatgggaatcccgaaaggaatcacactgatcgtcggtggcggctatcatggaaaatccacacttctgactgcactcgaactgggcgtttataaccatatcgcaggggacggcagagagtttgtgatcacggatgagaccgccttaaaacttcgttcggaggacggacggtttatcaaagatgtcgatatttccatgtttatcaatgacctgccaaacggaaaagatacccatcatttttcaacggaagatgccagcggaagcacatcgcaggcagccgggatcgtggaaggcatggaggcgggaagccgcctgtttctgctggatgaggatacgtctgcgacgaactttatggtgagggatgcatttatgcagaaagtagtcagcccggataaagagccgatcacgccgtttctttcccgtgcgcgcgatctgtatgagcaggcaggaatttctaccatcctggtagcgggcagttccggtgcctttttccatattgcggataccgtgatccagatggaccgctacaagccggttgacatcacaaaaaaggcgaaggcattgtgcaaagaatttccgatttcagaggaaaagccacatccgttcgccctgccacacagtcaccggatcatggaaaaagataaaaacggtgccacaaaacgcagggattaccggagcggagccgtgcgcaaaaatgagccggagcggttaaaattaaaaaccatgggaacggatggatttgccatcggaaagcagaccgtggatctgcggtatttagaacagctgatcgacagcgaacagactgcgtgccttggcatgctcttaaaatatgcggtcgaacacctggtggacggcaaacggacaattgccgaagtcgttgtacagttacagaaagaactcgatacgtccggcatgcgctttctggcagaaaacggtatcgtttccggcggttatgccatgccgcgggtgcaggagatgtattcctgttttaaccgttatcgtgtatagaaaaagggaagcacaggagagactatgaaaagaatattagttgtcgttgacatgcaaaacgattttacgaccggaccgctgggcaatgcagagtgtgcagcagtcattccgaaggtcgcggaagtgataaaaacaggcgtgtatgacagaatcattttcacccaagacacgcaccagagtaattatctggatacgcaggaaggaaagcggctgcccgtcgtgcactgcatcgaaggaaccgaaggctgggagattgcgcctgtgatccgtaaggcagcatccttttattccaaagaacagatcgagacgatctgtaagccggcatttggcagtgtgcagcttggcgagtgcttaaagcagtactgcggtgatgcagaggcacagattgatttctgtggcgtgtgcacgggtatctgtgtcatcagcaatgtcatgattgccaaagcctttgttccggaagcgcgcgtgtgcgtgattgaaaaagcatgtgcctgcgtaacaccggagtcgcaccgcacggcgatcgaagcgatgaaaacctgtcaggtggatatacagtaattgtatcttatttaagtaagaagaaaagagaagaattatgaagttaaatcagatcatcaccagtctgcttgaaacagatatgtacaaatttagtatgggagaggccatctatcaccagttctccgactataaaaccacatggacattcaagtgccgcaataccgatgtgcactttacggcagagatggtgcaggagatcaaagagcagattaaggcatactgcagtctgcgttttacggaggaagagctggactatctgaaccgcattacatggatcaagggaagctatattgatttcctgcgcctgtggcagccgcgctatgaggattttaagatttcggatgaggcggaatgcggactttccatcgagacattcggtacctggctgaatacgtccttgtatgagatcccgacactggcgattgtcaacgaagtgtatttccgtatggcgtacgattatgacaggctttatgccagtttccgggaacgtctggaacggaagatcaaagatgccagcggcagatacgagatcggttcgttcagtgaattcggactgcgccgccgtctttccgcagaggcacaggagcttgctgtccgcaagctgaaagaagcagaatttcacgggtcagaatttgtcggaacgtccaacgtctatctggcaaaaaaatacaatctgacaccggtcggaaccatggcacatgagtggatcatgtgtgtcggacagggaaatcacaaacataacccggcatactccaactggtatgcgcttgatgcctgggtacgcgagtatggcgtgttaaacggtattgcactgaccgatgcgattacgaccgactgtttcctgcgggatttccagctgacctatgcaacgttattctccggcgtgcgtcatgacagcggagatccggtggagtggggcgaaaaaatgatcgcacactaccggaaactgggaatcgatccggcaggcaagactttattgttcagtgattctcttgattttgcacgggcacacgaactgtacgaacatttccggaaccgcacaaaggtggcttttggaatcggcacctatatctcaaatgatacggaggtaccggcactgaatatcgtcatgaaaaccactctgtgcaacggtatggatgtcgcaaagatttccgatactccgggcaagggaatgtgtaagaacccggattatgtgcattatctgaaacgatgcatcgactggcgtatgaatcatgacagataaaaattctgatttacagacaaaggaagagggaacagacctatgaattatacagagtgtatcgaacaggcgagaggccgtatcggatcttactgtaaggcatgcagtgaatgtaacggcagagcctgtaaaaatcagatgccggggccaggagccaaaggcatcggcgataccgccatccgcaactatgacaaatggaaagaaatccgtgtccagatggacacgctggtcgaaaaccgtccatgtgatacgacactggaactgtttggcagaacgtttcagtatccgttttttgcaggtccggtaggtgccgtgcagctgcactacggagactgcctgaatgatatttcttacaacgatattctcgtttccgcctgtgcagcatccggcatcgctgcttttaccggagacggaaccgacagcaatgtcatggtcgcagcgacaaaagcaatcaaaaatgccggcggactgggaattccgactgtaaagccgtggaacatcgaagtgatccgggagaaaatggcgatggtaaaggattccggtgcctttgccgtggcaatggatatcgatgcggccggactgccgtttttaaagaatctgaccccaccggccggaagcaaatcggtggaggatctgcgtgaagtgaaacaggcggcagggctgccgtttatcgtcaaaggaatcatgaccgtcaaaggtgccatgaaggcaaaagaagccggggcagatgcaatcgttgtgtcaaaccatggcgggcgtgttctggatcagtgccctgccaccgcagaggtgctcgaagagatcgcaaatgcagtcgatggctccatgaagatttttgtcgacggaggcatccgttccggtgtggatgtgtttaaggcactggcactgggagccgatgcggtgatcattgcccgtccgtttgtgactgccgtgtatggcggagcgcaggaaggcgttgaggcttatgtcaataagatcggaagtgagctgaaagatacgatggcaatgtgcggtgtggcttcgctgaaggagatcacacgggattgtgtcagagtgtgagaattacatattgggaaaggatgaaacgcttgtgttcgtggcgcgtgccatggatatgggcgttttttctgttgaaatgagaaaatggatggattttgttatattttttgctgaaaaaggtcggttgatgtaaaaatgtgatataatagaaaataaaaattagggattagggaagaaatataggaaagtgtacggtttatgggacggcaaaagaagtagtatataggaaaaagtgtccctaaaatgaaaaattaaacctgtactttgacaactgaaaatggctataaaaggctcagacctcacggtctgggcgatttttctgtcaggggagtttttttacagccccctttttcttattatatatgtcttatatctctgacctgcttcagacaaaaatccgattagatatttaacagatcactgaatactttcagtgctccgtctgtctcatgtgcaagtacgcgctttgcaagaactttaccaagctgaacaccttcctgatcgaagctgttgacattccataagaatccctggaacatgatcttgttctcaaagtgtgcaagcaatgcaccgagtgtcttcggattaacctgctctccgataataatagaagatgggcgtccaccctcgaaattcttgttgcggttttcatcttccttgccgcatgcaaaagcaacgatctgtgctgctacgtttgcgcaaagcttctgctggcttgtgctgtcctgaatgacaacatctgtgtcaagctggttattcttaaatccaacaaactgcagtggtacaatatcggttccctgatgcagtaactgatagaaggaatgctgtccgtttgttccaggctcaccgaaaatgacaggacctgtcgggtaatttacaggctctccaaaacggtttacggatttaccattggactccatatctacctgctgtaaatgtgccgggaaacgattgagtgcctgtgaatatggaagcactgcggtgctcggatatcccagtacgttacgctcatacacaccgatcagtgcatccagcatctcagggttcttcaatacgtctttttctgcggagagtttatcctctgctgcggcgccatccaggaactgtgcaaatacatccggtccgaatgccagggataatacagctccaccaacggctgatgtagaagaataacgtcctccgatgtaatcatccataaagaatgctgccagataatcatcactctttgccagcggagaagtctcactggtaactgcgatcatatgcttagaagcatccaggcctgctttctttaacgcgtccttaacgaaagactcattggtcagtgtctcaagtgtagtacctgatttggaaacaagtacgaaaatagaatgggcaacatctacagaattcaatacagcggctgcatcatccggatctacattactgatgaattttgcttccatcttgaatgtgttgtttttctttgcccaattctcaagtgctaaatacatagcgcggggacccaggtcacttccaccgataccgatctggacaactgttgtgaatttttcaccagcagcgtttgtaatctcaccagcgtgtaccttattggcaaaatcagcaattctctgctgctgctccacatagaatttacgcttatccacaccatctgctacaacggcttttccaagctgtccacgggtcagctgatgaagaaccagacggttctctccggtgttaatcactgcaccgttgtaaagctcctcaaatttttcggaaagctgtgcttcttctgcaagcttaaccaaagcttccagtacatcatcatccacctgctttgcagcatagttgtacaccaatccctctgccattggaatactgtaatttttcacacgctctgccccgttctcgccagacattacttttttcagatctatgcgacctgtttttgaaaggttctgaaaagaagcaagggtatccaagttgtcccaagtaaccataatagattcctcctatatgttctttgttattttattcctcaaccttactgattatacaatgtaatttccatgaattcaagtatggatagtatgtgaaaaatgcgcttttctttttcttatactgtgatataattcttatagatgttttggaacggcatatgtttattgggggattacatatgattcataaaaaaataggggcgtttatatttcaggatgtacaaaatccaaatgagacaaaaaccactgctgtgaccctgcgtctgtacgcactgattctcagcgtttattttcttgtccttttttgtgtctgctgctttcttcgggatgttccttcctccctgctgacgctcatctgtggcattttatatgtatttgctttccggattacctatctaaaccatacacattttgcttccattttttcacaattactgacgttattgtggattactgtatttatacagagatttgggtgggactgcggtgtacagcacttcctgtttgtacttctcgtattaaattttgcagtcagtttccaccgcatacgcactaaaatctttgttggaatctgcacatgtgcttaccgcctgcttttgtattcctatacacggtatcatctgccggtcatccagctttccacagatgccagtatctgcatacagaccatagacactttgtttatttttgcagaactgatcacggttatgattattttcacccagaattcccagcagatggaacacaagcttatacgttacaatctggaactggaacacatcgcatccacagatcccctgaccgggcttttcaaccgttggcagatgtataagcgtctggaaacatgtatttccagatacacgcagcataaattacagaccctgactgttgccatgggggatatcgactttttcaaacatgtaaatgatacttacgggcatgatgccggggatgaagttctccgcacactttccaggttgttttgcacggtaataggcgaaaaaggagaagtctgccgctggggcggagaagaattcctgtttgtatttcccggcatggatatggaggaggttcagcttttgatgtctgaccttctggatgatatccggcacactcctgtattatacgaacgcaaactgattcatgtaaccatgacattcggagtcgaagaatttggcagaaatcataccatggaatctgtcattcaggaagccgaccgcaagctttatctcggcaaagagagtgggcggaaccgggtgatctactgattttatgccatctcacccacccggtggatttccgttctttttctgaggaaatccaaaaatctgtcacatacgacggtatatacagatcccatcacattgaatataattcgcagcgtcactgccgtacctgcaccgaataaccccgatgcaatcgacagtgcgccaaacgtattaaatacggtctgccatgcatatcctgcagaataacccacaccaattccaccgatcatcccgatatacggatacatggattccggtaacacatgatacaaaataaggaagatcatgcaccccacaatattaaacggtcccctgcgttttgcacgctccacactgtcctcatgaaatggaagacatacagacatgcaggcgattcccgcccacatggcacgcggccatccgagcagtgacacgatcagcagtgccgaagaaacaatcagtgtcagcttaatataccaccagttccgcgcggaacgtacatcaaattcccggaacagatccaggaaggtccggcgatacggacgatttttctggtttttataaaatacagccatacagatccccattccgatcagcagactgatgacacgcagtacataagcatgaccgctcacatcatatccctgcaaaagcagatatccaagaacaaacgttgactgattggacataatgacattgtggcatccaaaaatcataagaatcagaatacatgccacattcacaaaaaatgccggaaccggatgcatcatattggtaattctcggtcctgcgattaaaattccaaaaattcccgcaatacagagcagcccatgactggtacgcaccccgaaatctgcctgccggagcacaagtactgccagcagcacgaccactcccggtacactgttatctgcaccgaatattttactaaacagtgtaaccacagcgacgcagaatgccataacaagatagactttaaaattatagatcaggatatgtctgcgtttttcttttttgtctgttgtgtttttgatcagctgttttgagccaactgaactcagttgtagttcctggtaaaaagtcatcgtctgattccccctcgtttttttaataaaaaagtacgctggctttgtggtgcaacgatatcacaaagcgtagcgtactatacctcgatttttaaaaaacgtcaaggatacgtcctgttttttttagattttgtttagaattattttagatttttcccatctgaaaaagcatttcccactttttcgcccagcacataatactcattgttgaacggatcaaatgtgatcggctgtacttttgccacatctacttttccgtcggtcattgcagcttcatccacactgacattgacaatctccgctaccagtctgcagctttccggatcataactttttactttgcactctgcacagactgccagttcattgatgatcggagcgtctacatttgcactctttgtcacggtaaaacctgctttgtccagttttcctgccacattgtttgcagattcgattcccacataatcacaggctgccacatgctttgcatctgccatgcttacggtaaatgccccggttctctggaaattctttgttgtcttatgtccggcactgatgcagaaagaaatctcgtttccttcactgattccgccccatgctgcgttcattgcattcgccgtgccgtcctcattgtatgttgcgagaataaataccggctgtggataggtgtatggttttgctccaaaatcttttcttgccatattaattcactccttttcgtgctctgttttgaattatttggaaggatgaactccttcctctgttttatacctcacatttttgcaggaatcaagagggggcaggacatatacaggttttttgtgggattatgtcccacggcttttgcttcttgggacatatgtagattttgtgagcaattatgtcccataacatctggtgtctgggatatatagaagatttttccggagctatgtccctctttcttggacacacgggactttttctcctgctttttcgctatatgtccctcttctttagacttacgggactttttcctctgctttttctttatatgtccctcttccttggactcgcgggactttttcctctgcttttttctatatgtccctcttctttagattcgcgggactttctcccctgcttttttacatatgtcccatctaggttctgcaatagcatgaaatgaaggtgatatacttttatatgccccaaaattatatagctaaatacagttcgcactccaagatttcacacaggcaaaaatggcattttatataattatatctctgcacatactttgccaagtttttttgcatattcataaagctgcctatttttttcattataaggaccaaattctgtcaatgcgcaaatgcaggcatcacagtcatcgagcatctgttttgcccgcaaaaaggtttcttccgaaaccggaaagaatgctttttccgaaaaaacacaagcggcaagtgcagatgccgctgcgtactccacatcattttcctgcagaatgcctgctgcaaacggaatattctgccgctgcaggcggttgtaaaccgcaagccctgttccaccaccgccaatcacaaatacctccggaattccttccggtctttccataaaaacctgtccggtctgcggttcaaactgctgtggctttacaccgtacaactgctgcacgtagttcccggaaaagatttcctctggtgtcccgacccggtcaatacggtcccctttcacacacgcaatggtgtccgaaattttctgtgccagatccagttcgtgcaatgacatgataactgccaggtttttcttccgtgccagcatgcggatggttgtaagaatgtccagtttaaatcccatatccagataggaagtcggttcatcaagaatcagaacctgtgtgtcctggcagatcgcccgtgccagcataagtctctgcctctgcccatcactgattctccggaaatcctgctgctgcacttccccggcatgcaccagggcaatcgcctcgtccacctttttccagtcctgttgtgagaggataccaagcctccccgtgtacgggtagcgcccggttgccaccacatccctgccgcttaacagttccgtgtggatgcgctctgtcatgaccatcgaaagatgtctggaaatttcactgtccgtcagttcccgcatggattcttttcccagaaaaacactgccgccaatggttttaagctgtttggtgatggtctttaaaattgtcgattttccggagccgtttggtccgatcagtgtgaggatttcccctggccggacacccagattgatatttttaatcaggggaatccggtcgtatcccacagtcagatcacgcatcgtaagctgctcggcatcgtttggtatatcttgcgcaggaaactgccctgactcttttagcatattctgcccgttatgttgttttccgttttcttctttcatcactttccaattattttccatttgcatttttgtgtctgctcatagtaactttcttcctgcctttgcgtccttatccgttttggctttctgtctgcacgttatttttcttccacgattcatcacatctgctgctttcgcaacattgccgcaattaccaccggcactaaaaataccgcagtcaccgaactgatactgatctctgtcggtgcaaacaccgtccgcgcgattccgtcacagaacagggtaattgctgccccgcccagaaaacatcccggaatcagaataatgggtttggccgtgcgggttgccagtttgatcagatgtggtaccgcaatcccgacaaaagaaatcggtcctgcaaaagcggtcacacaggccgacaacagacttgacagtaaaatcagtgcaatgcgcagtacttttacatttacgcccatatttctggcataagattctcccatctgataggcactgattggttttgcaagcccgaaggtaatcacaaccgtgattccaacaattatgaccatgatgcgaatgtgctcccagctcataccggaaaaacttcccatcgaccagttgtgaagattgacaatattggaatcgtccgcaaacgtcacacaaaaatctgtaatcgccgaacagatataaccaatcaagataccgcacactacaagaagcgacatattcgatacccgaaacgaaatcagaaggacaaatcccatggcaagcagtgaaccggcaaatgcagctaccaccattccaagggaactgaccataatccctttttccagaagaaagatcatggtcagtgccacgacaagtttggctccggaggaaatcccaagcacatacggtcctgcaatcggattctggaaaaaactctgcagcaggaaaccggatacggaaagtgcccctccgagcagaactgcagcaatgatacggggcagacggattttccagacaatctgatacagtgtggaatccggctgatgttttgtcagcacgcccagaaaatcaaaaaaagacatttccacacttccgacaccgatattccagaaaaacaaaacgaccagcaatcccatgatcacaagaaaagaaaccagatagcggagcgttctgtttgtttctgtcccggaattattctttttttcttttatttgtgatctcatgttctgctcctcatgcattacgacaattgttattatttgtacatccgtacgctccggctcactgcaattgcttcaaaaaccggtatgttccatccccttctcccgtcaggatctgattcagatcctcgataaaatcacaggttccggtagactgctggtaaaaattgcttcccgttgtgtacacctgtccgctttttacagcctgaaaatccgcaaacaggctgtttttctttaccagctcatcgatggacgtcaattccccctcaatggttccgttgtagatcagcacatccgcatcaatctccgcagaataaaaatcttccatctgcattttcatcgtggaaagtgcatttttttcttcatcggtataatttccgagtgaataggttccgcctgcaagtccgatcatcgcagagacatagtcgtttggcttgcgcacagtgatcgtcccgtccgaggaaactgcaaaaaatgccacctttttcccggtactctttttttccataatcggtttcacacgttttacctgtttattaaaatagtcatctgcctgctgttgttttccaaacaaaacaccgaacagtttgatccattccagccgtcccagcggatgcttttcataactggaacgctcaaccatcacccggatgccaagttcttcgagtttttcctttacttccggattgtgcgtgaccatcgtattttcaatggcaaatgtgcagccaccctgcaacagctgttcgtaatccggcgcactgtattttccggcataaaccaaagaaccgtctgccatggcatccttcgcctgctgcacgtaccagtcgtcttccttcaatgcggtgtatgcaacgtgtgacagcccaccggtctgacagatcagatccatcaccgcagacgatacaaggtacacatggtttaacggctgctgtaaaacagttacatcctccggtacatccgctggcaccggaacccctttcggaataagcaaaaaacgaccgttgtccacgatcgtaatcagcttataatttccatattcatcgatctgaaactgatcggcataggacaattttacctgcccggtctgtttcagctctttaaaacttacatcttttgcaaaagaaaatgtcagggtgtaatcaatctcatgcggctggctcatggctgtagtgtctcctactacatccatcgtacacggaactccggcaattggaaatgtaaacgttgaattcccaccctcgttctcatttgtatatttttttccatcgaccagcatgtaatcgtaataggtactgctccagactatggttgcatatgcctgtccgtccgtcactttcacttttgcttcagaatctacggaagctctgccgcttccgccttccagttctacatttacggtgtattctccgtcttccagcgatgtgtccggttccgcggtggcagtctgcgtttccgcggcatgctgcacctgttctttttctgccgtagaaccacagccggacaaaaccgacacacacatacaaagggacacgataattaccgttaatttcctgcttttcatactttttctctttgaccggatgatttctccgatccatcctatctgttttcctgtaacttctgacacatgtacatcattttcaaatacgatgtaccggaattgccgccgtctggcagacaactcacattttattttttctgtgcatctgatacactgactttatgatcataccaggttcccttggttccaagaattgcaaggtcaaactcttttccaagttcttctaccggcacatcaaatccgtaaacttcctctgtcgttccatcgctgtattttactttatctgtcgttggctgtaacaattctacaccgtctttttctgcatcttttgcgcttcccagaaacagatttacgattttcttggataccagacggatgtgaatggtcatctttttgtcttttacggtaagggttccacatccattgtctgcttcattgacatgaaacatcccactgtcggtattaaactttgcggtataagtgccgtcctccagcgcggataccgcgctggaagaagcagacttggaaacttttccaagtgactcaattgctttttttgtatgctctacataaagtttctggacagcttcaatctcaccaagtccggcaatctgtgtgtcaacactgtcgaaattgccgcttgcagtgaactggctcttccaggaatcgtcatcgtctcctgccatatcattgtttgcatgatctccggcaacaaccatgagtggacgaagaataactttcttgtaacctgcgtccttaactgccttgattacattttcacaggaagtctcttccggctcaccctctacggttccgataaagacattgtcataaccaagcttatccatctgtgtagacatctggctgtaacttacctttgcagaatgggaagtaccgtgtcccatgaatacaaatgcagtaccgtccttctttgcggcatccagtgaatcgtatcctgcggtttttacggcttctgctgtaatatcttctgcaactgccttcttgtcatcgttgatcactgttgcatcatcaccaacttcgccaagcagcggttccgcaacgacaacttttgcaaacttatccttatatgcatccagctctccgacaagttcatcatactctgccccatgcatcaggtgtgtcggctggatcaccagattctttaccccgttatcgaccgctctctgtaatgcctggtctacgttgtcgatcttctcgccatctcttgcctgtacgtgattgataatgatctgtgcggtaaatgccctgcggactgcccagtccggatttgctgcctgaatggctttttccacaccactgatatctgcgacacggctgtcattaaaagatgtaccaaagcttacgacaaggatttcgttatctccgatattatcctgattcaacggatcatccttggaagcatcaccggtatctctgccgaaataatccggatctgcattttcaccggaaacaagtgctttctgtgcatctgtcagcttgtcccatgcttcttttgcagcagcacactgctcatcggttttatctgttctttcctgaacataaatagcatcaattaattctgctacctcatctgcagctgcctgatcgtcttttgcagactctgtgccctgcgaattttctacctgattgttgtctttgctgtctttgtttccgcatccggcaagcatgcctgcagccagtacacatgtcagaaacaatgcaagtgttttctttctcataattctctcctttttgaaatacagcatagactgcatttcctgcatacaccacatccaccctgacggatttctcatgcgatgtattctttgggttgacgggttgcttcatctcataagatcacgcatcatccaaagtgccaaaagaaaagccccacccagaacattccgaaaggagcaatcaacccatgcaaaaaggaactgtctgtggacagctgtcccacacagttttctgtaacatgcagtacgatcaatgactcgtgatctgaaagtaaaaactttctgtaccagatcattggcaggtttcctggctcatagatcatcataacatgcttcgccttcccaatgcagctgcatcagtggcatatgaaatgcagcctaagctgcatttcctacgtacatcgcatccgcgtcagcggatttctcatgcgatgtgcttcttgcagttactccctaatcacagtgacgagttcgtacaggattttcacctgtttcccttttaccctgcgcatacaagcccatatatcccatgcaaagcgactttatatgacaggcaccaacgatcttctttatgaaactttctacatattagcatattgcgcgtttatttacaatgcgaaaattacgtcttttccgttttgatccggcacaccacttccgctccagactccgcgtggttgtaaaaacaaagcatgcccccctgctcttttaagaatttttttgcgatcgcaagaccaagcccctgatgcgtccggtcatgccggctggcatccccgctgtaaaattcctgatctgcatagatgagatcctgctccgaaaaaccctttccaaaatcgcggacggttgcagtcagatactcctgcccctcatacacttccatctgcaggcgcaccacgatcccgcgcgcccggtctgtgtgttccaccgcattgctgaccacatttttccacgctctgccaaccggtcctggcttgcagcatacattcccacacagggaatcctcctgaaaaacaaccggaactttttccgctgccgcaatctgcatggctgcttctttgaactgctctttcaaacgcgcacaggtgactacttctgtctcctctgcgcggtcacgtccatacagcagttgccgcatatgctccaaatactgctccatgctgcccacattcgccaaaatagcatccgtacactcccggttttccgcagacaaatccgtctccgccaaaagctcggcatttcctttgatgacagtaagcggtgtcttgatatcgtgtgtcagtgccgcaagctgctcttttttctgctgctgtgcgtcccactgtctggtcagcgaatcttttaatgcttctttcatgccggaaagtgaggacatcacatcgtcaatctccttaatctgcgatggtccggtttcaaactccagatcattttgtccaattttttccgtaacttcgcgtagctgcctaagctcccgttttaatttttttgcaaaatggccggacaacaatgtggcatgcaggaaaaacagcaccacgccaagcaccggtgtcagtatctccagagatggaacaatgccgtttaatttatcgtaagcatacctcatatgcaaatcgtattttacaatacagatatcgccgctgttctgcttaatatagcggtaatactttcccatggatgcatacttactgccgtttttatacccctgccatgcccttttctgcgcgtctgccgaaaaagttccggtcttaaaccgccccgccgcatcgtaaaccccgtatctgcatccatccggaatcagggcttccacatctgtccccgcagccttaatttcttccgtatggtccgtcagttgcagctccgcataattggcaggcagcgtaaatcctgtcatgggacttaatactagaagcaccagacagaacattccgattccgaacgtatccagacagaataacgccgcaaatttcaaaaacagcccggtcagtgttttttgtcttctttttttcatttccatcgatagccgatcccccaaaccgtttcaatcgggttgatcccgaatttctggaattttgcacgaatattttttacatgctccgtaattgcggaactgttgctgtccccgtcaaatccgaatacatgctctaaaatccgttcttttgaaaatacctgtccgtggtttaatgccaaaaattcgcagatcgtatattccgcctttgtaaaaacaagttcatgttcctgcacatagatttttctctcctgcatggaaaaacgcacctccccgatacagatcgtatgcgttttttccctgttttcccgccggatatgtgcagcaactctcgcccgcagttccccgatcccgaacggttttgtgatatagtcatccccacccgcgccaagcccggtcattacgtctttctcttcggtttttgccgtgagaaacagaatcggacaatccactttttcacggattctgcggcacagatcaaacccgtctatgcccggcatcatcacatctaaaagaatgagctggtatctgcccagtttgtcttcctccagttgcagcggatcttcaagtgccgtcacctgatacccttcccgcaaaagtgcttttttgatcacagctaaaatttcccggtcatcatcaattgccaatatctcagtcattgcactgccttccttcatatttatgaaaccatactccgattatgacacacatcagaaacaagagcaacagacaaaacaacacacgtttcccgtttacgggatcattgcagtaccgaatgccccttgcactccacgtagccggaaaaaactgccatctgccctccccaagcccggtgagaaacagggcggacaccaccgactgcaccacgcccacgcactgggatacggtctttgaaaagatcagattcaggaacaaatgctccagatacaacggcacacttccgaaaatcagtgtccccgtcagccgcacataccgcatgccaatcccctcttttcccagtaaaaaatgatacccggcagcaaaaagaactgctgccccgaaaattgcaagaaaccccatgccaaaaagaaccacgccctttacaacaaatcctttgccctttactttgtagttcccgagaaatacctgaaaatgattctgctcctcaagtccgatatttcccgcacacacaatgctcaccacaaacggaagtccgataccgatcagttcaaaatatgccatggtctgtcccatgggatttcctatggtcccgcgataataaaacagcatgaaaccagcgatgataaccggcaccgccacatgaaacggaattaaaaaagtatgcttcattttcaaaagttccgcccggacacttcccatcacacgttttgtcattctgccacctgctttcgaaaccatgttctgcctgccagccagaataccagaaaccacagaagtgcggcaggaattccaatcaacagcccactcactctgccgagttccggagaataggtcacctgccccggctcaaacggcagtccgtttggcatcactttgatcacgacacacatcagccgcgatgtgatcgctcccggaaacaacgcaaaccacggttttaacgataccgacgtagacaaaatactatagattccaacatggatcacaagcatcagaaatgtgcttattttctgtgcaagaagcaggcagaacggaatctcccagagtgtggtaagccacaacacaattcctgccagtatctgtgccggaatcgggattgcctgcctcatcttcagattccccacagattccagcagcatctgccccatcatggaaaacagcgtaagtccagcaactgcaaccgccgacatctttattccgacaaggatttttgcgtcccagatctgttccatgccgcagggcagtgaccatatcgtgtaattctttttctgtttgtcctttttcccgatgatgctgcacaaaatgcccagaaaccccggatacagcccgatgtaccaccagttgtacacatcaatggaaaaataggaagaggtcagccagaatgccagcaacgccgtaaacaccggcatgccgagcgtaattgctgccacggaggtatgacggtattttaactgttccgcctgaaaataatgtttcatgattcattccctccttttgcgacaaccttcataaacaatgcttccagatcctgctgttcctgcagttttccttcaaatcccaccgttccctttgcaatgatcccgatgtaatcggcggtctgctggatttcacttaaaatgtggcttgaaatgatcaccgtaatgcctttttgcgggaaactccggatcagtgcgcgcagctcctgaattccaagtggatctaacccgttgaccggttcgtcaagtaccagcagtttcggatcattcaaaagtgccagaccgatgccaagccgctgcttcattccgagggaaaaagcccctgcttttttctttcccgtatccgtcaggtcgacggttttgagtactttctgaattttttcatccggaattccgagaagaagcgcgcgcactttcatgttctcccacgccgtcaggttttcataaatgggcggtgtctcgatcagcgcgccaatatccgccagatctgcccttgtccacttatgcccctcaaaataaatttcaccggacgtagggtttaacagtccggtgattgttttcaacagcgtggattttcccgcgccgtttgcccccaaaagtccgtatacacagtttttggggatttccattgtaatatttttcagaacgctttgtcctttaaattcttttgacagatttctgattgtgatcatattctgttccatgtttcatcctcctcttgatttgtaaaatcagtataaaggagaattctaaggaatttataaggatctttttattttattttatttgcagctttaaaaatgcctgtttctgcgacggatcttccgggctttccacagcaggattgctgtctgcatggcataactttttatattctgcgccgcatcaagctttttttgcttttccaacagctttaccatggtgtcctgatacagttcgtttccacgctctgtactctcggcattcatcctgcagaaccgcagaatgtcttttccatgttcggtgacaaactgctcaaattcgtgcttatccatccctgatcctttttctctcttaaatcgatttaaggggtttgcccttacacttttatattgtcctgaactggcaaaaaggttttatttatactatgataaaatcttgaatcatcaaaaatgtctccgttttatttttcaagcatacttaattaacgacaaataggaatttccataatagaacttgcagttaagaggcgcctggaaaggatatgcgaatcccataaactgaaataaacttaaaaacacccggttaaatcacttgatgataaggactggtatctatagataaaaaattaaatgctcaggtgacgttttttcgaaattttagtgcttgaaatcaggaaatgtcacctatatagtaaaaattgctttttcaggtaccgcttttttcgagaaagtggtatctggaaaagcaatttttgatctatagagactttccggtatctgaatgttaaattttcaatatataggtaccgcaatggtatcttttacatgaattttattggcatagataccacaatggtatcttttacatgaattttcttccgggagcgcctttaactggagaaaatccattatacatcagataaccctgtacgacattcttttcagaaaaagttgtaaattggtgtatcttttgttagctacatgcgtaaaatcctaacgtaaaaatacatccacctagcaaatttttgtttcaaccacatatctctccataccaccaactattctatatttctgctaatactgaaattttatccatcatatttacctacaattagcccacatatcatccccttttgtagatgcccatatttctgtgaatatatcaaatttactcagaaaatccctgcattccttctcaatatcgccagacagatacttgtccatgaaattctgcatatgataaaaaccgatctgcgtgtccccatagatatcatatggtacatctgccaaccatgttttattcttatatgaaatttccacatatcccttttggtattccagccggttgttctcatcccagcccggaacttttttcgactgatagaaaaatttaaaattttttggcggtatagaattgatatctgtcatgctgatcacacgcccctgaaatgcatggtgctgccatactttattatagtcagtacctcctgcaagtgccaaatcaggactttgttccactttatcaaaatcaacatcctccgtttcccattccctactcatttcatgaatggtctgccggatgctgtttctcatatcttcttctttgtaataatagtctgaattataatacatccaatcataatcatctacaccaccatatctggttgctatttctgctccttccctttcatttgcagcgtaagcggcattcacattgattttctgcagaaagccgtatatgtcttccaatatctgctgattatcttttgcatggtatccatttgtatatctctgctgaaccatttctacacgcatatccatacaaatattttttatcctctgttgtacgttctctgcggacatttccccggaatagtaggaatccatcatatctttcatattttgtatgacctgtcctccataacttccgcttaaacaggatgatggcattccctttattttcataatatcgttgtaattttcacttgtaagttctaatcgggaaatgccttttgcgttcaattcgtaataagattttgcctgatccggcaatttataatcatcgccaaggtatttatttcttatttcttcattcgcctcttccgaaccaccgatcacatagctttttgacggatctgttcggcagacattgatccaaccgatattgccttgtatgttcatataccctccctatatagtcaagtcctttttccttatttttcaaggaatttttagttgcttatctcagttaaatgagccaatggcatggatatttctttacatctggtactaaacatagatgattagggtatacgaagtaaaacgtcattgtttctcgctttacatggccttgtgtatccccttccttctatggtcgtcaacctcccatgtctaacaggatctttgtcccaacttccttcgttttgcatatccataatccgggtgtcagctcagctccttcacaggatcgtgtcctctggtgattattcctgccgactactggctcattctttgtttgtattactgactttgctctggcaacagcacttttcagcggacgtttatctgttgccatctgcttttgcccttacagggcactttccggcttaacctcttgattacttctttatcgtggctggaatcaggtgtcaggggtggaaccgttccacggcactttgtgcccttgatagctgattccaaccacgatacacttacaatgaggttcagctgttatgctgcctgcagcatctgtttttgtggtcttctgatgtcacttatcatctttgctccatcgtaatcaactcctgttgtcagaatcttatatgcgattctcaaaaacttacatgccactgcaacaagcgattgtttcttctttaaaggattctcttcccggtgcgtgtaatagtagtgcagttctttgaattcttcattcttacctacaagggacagtgatgcctcgaacagtaaatatctcagcttctttcgtccccgtcggcttatcctcgtttctccctgatgctttcctgaactatcctctaccaacgcatatccggctaatttctgtatctgtttcggattgtcaaaacgtcttatgtctccgatttcagctactaatcccgatattgtttttattcctactccctttatctggagcattttttctacatatgggatttcttttaccagttcatctataagttctacaacttcttccatccgcttgctgtatctctcatagtctgacaaaagattttttatttccatacgtgctgtagtcagaccttcccggcttccaatgctgtgccctgcggcatccacaagctttgttgctcttttcattcccacaccccgcagctttgcatcacgccagattttgttgaccccatccacacctccttccatttacacggtaatattttcattacctatttttgttttttaggtcttttaggctgatgcaaaataactattttaccgccacacgcataaaaagccgtctcatctgagattatttctgacttgtacttataagattctgtcaaatatcaaaaatcattttgacaggctgatcccttcaaaaatatttatcatatgattttttaaatcaaacctactcaatatagaactaacaatattacttacgccttgaatatttttattataatcttcattttttctacataataaatactcgtctttcatatcatccataagttcgaataatttatcagaatcgtccttatcatttgcagcatctatattgatctgatttccaaaaactgtaatgtttcttgctttttcggtttcttttcgtgaattcatcaccatcgtctgccattctatttccctcttatacgcattatttaaacgatctatttcttcttcctttgataattttctttttcccattttttcatctgcaacccatacttctcttgtaccattctcatatccctcatttattttttcatacagacttgcatatgctcccaatgatgcagacataatatcctcaaatccatattgcatccctttttctcgtatttcttgtaatgattttgaccgttgcatactcaattcctgtgaccatacatcagcacctgtactgtctaattcaacagcaccagattcttccatttgatacaaagaatcattctttttgcttaaatactcctgccacttggaaacaccttcttttgatatatttactatatcggtattattatatgtttccattttttgggattcattttgtgttttcaattcatttgagtatgttatgctatttaaatttactcctgatgaaattttcattgattaatcgtctcctccctttggttcttctccattccagtacggataataatacttcatagtataaggtctgtaatatgttattgaatgatttccaacttcataaaaatagttataccactcaatatctatgatctttccagtgtccggatcaataaatacattacacatatttaaatctgcccacagataattttctgcatatgcacccgaacaaatattatgaatcgtatagcatttatttgaccaatcatgtacagataatgttaaaacatctttatttgatattccagtaaatgttgaactatgatagcgtgccacatctggaattgtctgttgtaactcaggtgaaatgcttgtaccttcttcctgtaacaaacacacaccgaagttttctgtcttttttaaatttatattatagttttgaactccagcggaatttgacaaactcttagtatatgaatatgaaaaatcaatgggatttccattaacataatactttgttctttccgaattaaattgaaaaactatacctgccttttcacaacatgcaaatatggttgccgtactatctgttgacactggtgcaatattttcaaatttaattgtatatgatgatgtccttgaatatgttccattaggacttgacaccttaaaataatgtttccccgcttttaatgataccaattgtcctttaattatatttcctccggttccacctgcatactcaattttatatccaagagtagacaaacttgaaagtgaatatcttaccgcacttgcctcatctaacgtaatacaataataatcacaatcaaatggattatctataaacgacgatatacttgtattttcatctactggtgttgctaaacttgcgctatcatttacctcatattgaatatcctgtgtactttgataatatgcaattgcataccgtccgcacccttcatatgcgctaattccaaaataatatataccttcgtctagcacttctgtgcaatactcgcttaccccaagtccagatgtagcactttctccaactaaatttaattcatgagtatcttgattcagtttaaataaataaatgtctgcatccacatttgaaaccagctgcaacattatagatgcttttgcacgttgttcaagtataaaaccataccatctcatctcaccttgttcagtcaaagtaccttgaacgacattctcatcctcaatcaataatgcataattgggatctgtattttcactctcatcttcagcatatcgtgaagtctcatttatacaatatgttttctgtacatcttgtctatcatttttattaattacatcattagatattatatttgtatccaactcaacagactgcacatttatcatttgttcatctgcatgctgaacattttctccattgttttctaattttaaagaagtaattgtactcgtcccatgtgcataagccgtaatagaaccttcaaaattgtaaaacaataataatgtcatcattattgcaataatctttgccaccttttttctttttttcataaaaattccaccttttcttttgtaatagtttagtaaaacaataccttacgatacttgctaaacttagaacaaccattcagattcctctatttactaaattataggaatccaacaaataaaccctctaaccatctttcactttttattctttggctggtcagacgtttcggctgatgccatattcctaaagctttttaaacttttttcattttattttccacctttcttacacagtaatattttcattacctatttctgttttttaggtcttttaggctgatgcaaaataaccgggcaatagcgagaagcttcatttccattctgctctacctcaagttttaccgctttttgcattaagcttaataactctttcttaatattattactcatcacatttcacctcctgtccagttatttttcccagtgttaataaaattgcacataaaatcattccaaaacttataaacagaatatatttttctgccattcccagatatgtaagtgcaataacaactagcagttccacaaatactgttatcctggcaagttttttattttcctcgaattcttccttattccaatccatgccaggatgatttactgctcctaatacaaaaataaccattgctgatacaagaaaaactatcatatttatctttatattattaagaagatatggatatatcaattttatgtatataagatatatacttaccgttccaataaaacagcttctaaaactgttcgcatgatacccacctgtgcactttcttaaacttgacaaagatatagtaaataaaacagtttcaaaaaaatatccttgaaataacgctatcatataaatagccgaaaatcctattatcttttcaataataagttgtatggagtatgaataaatactctcatcgctttcttcaatcagtccatccatatacatgttctttgtcagcatatttgcaatatattctgtcatgacttaatcatctccatttcactttatctttttattcgtcacttcctgtctaattccgtatatccattgcagaattggaaattttaaagcagaattggaaataaaaaaagtagatacaactataaatcgcatctactcttcctgattatgtattaaaattgcaaccttaaaattatttttatcatgttttatcacgcaggaaccgtcatatttttcaacagtttcctttatattttccagtcctatcccatgtctgtctgcttcctcatttttcgtcgttatgtatctttttcctacgattaccggtttccctgaaaatgtatttgtaacagacaaaacaatctgatgttcttcttttacaaatttcatttttatgattgggttttcacactgttcgcttgcttctatcgcattatttaataaatttgacaatatcagaacaatgtcctcatctttgattctcaaagccgacaggtcatttaccttaacaacaaatacaatgcctttttcccttgtttcctgataccttgagtttaaaattgcattgacaattacattatttgtatcaatgaaatctgtgtgctgcatgatttcatgattatattgcttcagataatgattaatctcgtctgctctgttttcactggccaacgcagcaatcagtgcaagctggtttttatactcatgttcccttttcttctgtttatcatagttttctgaaattgtccggtacattccggtttcatttttaacccgttccagcaataagcggttctctgttatctgtacttctcttttcaatatatcattgatcagacaaaaaatgataatattcatcaccaatagtccaaatgcaatacagatcaatatatttttctgatgactgctttccgggatttcaaaattcgtcagaagtgcaatcaggacaataattgtataaaccggaacgatcgtaaatctcacccattccaatgtggtgagcatctccgaagatttttttacaacatatcttcgcagcaccataataaaacagacctgcagcatctggcttaaaattccaagcagcgcatttatcaataatggttctgataaacgttctacggtaattgccggaaaacatttagacagcatcaaaatagaaatataatccgttataaaacagattccctgataggatataacaaaaattgctgtttttatacaccgctgtctgaaatacaaacacatgaaaagtgttcctgccccgataatagccacttctttcaggataatgtcaccatccagttttactgaaataaagtagtctgccatgatcataccaccgacgatcgcataccggcaccatttacctggtaattctctttttttggcaaaagtcccgataaacattatgcacaatattacaaaaagcactgtatatagtactccataaatatccattttcattaaatttcacctctgtaacaagcaaattcatttcttgtatctaaaaatctcgccttagatattgcaagactttttccatttgaaagaacagcccggtaacgctccacgctttctacatattttaaattcaccagataacttttatgaatccgacaaaaatctttatttggcagcaattctgcaatatcatccaatttcatatatattgtataatgaactgcatcctcacccaccatataaaataccagtcgatgcagattgctttctatataaagaatgttttccagactgattgttatttttccctgaaaatcaaaggtcatttcattttcttcgtaatccattttatcaaggattgtgtccatacactctgtcattgctttttcaaggctttcatgatcctttatgagataccttactgcatccaccttgtatccttccaacgcatatgtaataaaagccgtcacaaaaacaataaaaacatcttttgatattttccgtatttcctttgctgtctctattccatcaatttcttccatattcacatcaaggaaaataatattatattgagaaattgctgatcttaatgctaataattcttttcctgactcatacatatcaatcatacattcgcagtttttccctgccatatattttgatataagcttcttttctgttgttcggaaatattcttcatcatcacatattgcaatcgacaacatcacattcacctcctcagacacagatttcccggttggcacgcagggtgtctatacagcatcattaccatgtatggagaaatgcacagaattccatactttttgattatgcgcacctttattctgctacattctttgattatacgcaatattaatttcaatttttatcatgttacagtcaactgtgaaatgttgtcttgtgaattcttgtcatctaaaattcttcatgatatgatatacttggtttttaagcaatgatgtatacgaggagacaggtatatggtagatcttaacattcccgtcggcgtttcggattttgaaaagcttagggaaaataattattactatatcgataaaaccggatttatttctaaattactacagacgaaatctgctgaagtaaccttaattacacgtccccggcgttttgggaaaacacttggcatgcgtatgctggcaagtttttttgatattcgaaaagacagccgaaccatatttgaagggctggaaatttccaaaaatactgctttatgtgatgaatggatgaatcagtaccctacactgtttttgtcttttaaagatgtggatggacttaccttttccagtgcctgcgacatgctgatgtacaccatctccgatttataccagcagcacctttatctgttagaaagtgattctgtaaacaattatgataaagaaatcatacatcatattgcagaacgcaaagccactgtctctgagatcaaacaaagtcttgtattgctgacaaaagctttggcttcttattatgcaaaaccagtcatcctgttgttagatgaatacgatgtgccaattgcaaaagccagctctaatggatactatgaccagatgcttgagattatcaaaggaatgctcagtacttccttaaaagataatgctgccctccggtttgcagtgatcaccggatgccttcggattgcaaaagaaagcatttttaccgggacaaataattttgtatctgacaccattacagattgccgtttgaatgaatattttggatttacacaaaaggatgtagaacagcttctgcgggatgccgatgccatggaacattccaaagatttgaaattctggtatgatggttatcactttggagatgtcgatgtctattgtccgtgggatgtcatgaattatatgcgtgatctgcaatacaatcccgatgtcaggccggcaagttactggaaaaacaccagtgataatgctattgttcgttcttttattgattatgccggaaataccattacccggaaattggaaaccctgctttcaggcggatatattacacaacagattgatgaaaatcttacttacgactatctgcattcttccgaagacaatctctggagtattctttatctcacgggttatctgacgaaagcccgcgatgcagatctccctgaaaatttgccggatggtatatccgcactgatgattccgaatgcagaaatccgggaaatttttgagacaaccattttaaaatggtttcaggagagcgccctgacctggaaccgtgaaactctgtttcatgccgtatggaatcaggatgcaaagacaatttctattgaaatgacaaaacttctgcgcaaaacaataagttaccatgattacaaagaagattattatcatgcttttttagctggcatatttgccggagccggttatatggtagactccaataaagaacatggggaaggacgcagtgatgtggttgtgtacgactccctcaatggccgcgttgctgtctttgaagccaagtacgccaaatctctcaacgatttagacaccgcatgtgaaaaagctgtgcagcagatggatgatctcatgtatgccaaatcctttgaagatgattatgatgaagtcatttgttatgggatttcattctataaaaaacgctgtgttgtgaagaaaaaataattcaaattatcagttgtaaaacacctctgaaaaagaaacgccagatccggcagatgaagcctgttctggcgcttctttgcagatttatccttatccgcactcgcgcaataaatttctttcctatttttgtaatctcttcggtaaccagcttcatctggtgtcgaattatccttcgaataataataaagcccatatccctgctttaccaatgcctctgctgcaaaattttcataaagcgcacctttataaatgccaagatttttatttgcacgcaaatcaatttgtgattcatcgtccagacttgccaccaataatccagtatccgaaatatatactttatatttgctttcatccacatttccttttaatggcaattccggaaattgcaaacattcacatacattaataagcccggcatctttcaaccactctacacatcccatataatccttagatcttccgcccttagagactttcgaatattgaaattttttattttctttagcaagctgtgctggaattgaccggtatacactcagaattttcgccttatccagcccttgtgcatactttacaatatcattttcataatctaccaattcgttttcttcaaaatgtttcgtcggatcaatcctgctgatcagcttgataatatgttctgctgaaaacccttcctcaacaataactttataagatggctctgtaataaagttgatctcaattacatttttatgagcgattttttcttcaatattacatttttatgagcgaattatatttattttttacatttttatgaggaaatttacttttttcaagagtctatcttgatcgtttctatcaatttttctgttgtttaatcaagcaaatgttaattttttaccaaccgtaactcatacctgcataaaaaattgatggcttagaatacattgttccaagccatcgtaaaaagcttactattctgtcgattctgccgtatccggcttcacatgattttctttgatatcccatgtaatcgtatactcttttcctaacatcgtacccatattttttacataatcctctaacatagactgcaccctttgttgtgcctgtgctaataaaacagtatcatttgctgctgtcttctccatttctttctctgcctttttataggctttcgtctgatcatctgcatccgctattgctgaattttttgcataataataggaatccttggtaatgctgtcgggatttggttttgaacttaatacctttgcttctggaatatgtatttttacattttcaccatctacttttacatctaactttgaactatcaatgccaagtgtaactatcccatcataactgatccaaaaatttttatctcttttccataataaataaccagaagcattttctttcttttcatttttcttttcctcataaattattgtttatgacaaagaaaaggacctttcgatccttttcttcatcccaccatcataaagcagatcctattggatttctgcaagctttttcacaatacgtgcctgcacttttgtatagtaggcggcatccgcagtcgacagattatccgtatctacgtcatttaacttctgcatgtaatcggcatatttcgtcatataatccgcataatcatttaacattcccgccacatcatcagaattttcatactttttcataaactcgatatattcatcaaagaaatcttcataactatccatcatcttcttaaaatccgcatcaactgccccatctttctttttagaactggttttctttttctccttcttatcagtctttgaggaatctttggatgtatcttttgcgttttccgagtcatctgtttcttccggctcctctgtttcttccggctcctgcgtatcctccgtatcatcgtccaggtcatagatatctatattcattgtctttttccttttatcataactcagcgagagcgtatatccatctttattctctgcatcatatgaatcttccgtcccataataatccacattaaatccgttttccttacatgcatttatataatctgcaaactgtgatttcgacgtattaaaaacgtcaatttcaaaagaatcttctgcatccaatacaatttctccgtatttcgattccggaacaggcaacgattttaccagcgtacttgtcggccaatgatactctgtttctttcgtcttcatagcattacaaccactaagatttcccaaaatcattattccacaacacattaccattattaatctttttttcatttctctttgtcctcccttttttgatcctgcttcatttttctcaacactgctatatgatccatataggtcttttccacagtgttttcctctgtcggaaccggtaacattccattttgctgcacatatgaaataaattccatctgcccgttcagctgtctgatctgttgcctgagccctcggattttcttttccagatactgatttttttgtttctccgaaagcgtcagaagatctttgatttccttcagatcaagccccattgcccgatacaccagaatctcccagagacgttccagtgcagcgtcatcgtacagtcgataattgtctttcgaccgctgggcaggcaatagtccttcatcatcataaaactgcaaagttctcttgctcactcctgccagccggctcacttcgtttacttttttcattacggcctttacctttccccgtacttttcagcataaactatcacgcatacgtgaccgcaatactgatttccagaaatgccatttcttgggtttcataaaggcctttgaaaaatttgcgaggtaatatttccggaaataaaaaagctctggaaaacatctgttccccagaactttttatcctttattattcatttttcttacaaacctgccggatcagctgaatcagtgccaccactgccaatgctatatgcccgtaatcatcacaagaaaacccgtctttcttcttaaaagcccagattttcatccaccagaataatctgaaaccgtcctttgaccctgctgaatcgggttgtcagaatctgacagcagatacactgtggacttttacagtcaaaacaacttccgtttttggaacatggtgtgtcaatgccaaatcgctgtgcattaatcggtgccgcctcattccgcgcacggtgcagggcgtcttcctcggattttacgactttgttcatacccacaatcagcagaacatgctttggtccataggcatacgcagccacacgattggcatttccatcgatattgataaacacgccatcctcgctcatggcattgacactgcctaaaaaataatccgagctgaatgctttccgcgcaatctcctctttttcctccggggtttttactttatcccggtcataaaattcatactcaccgttggaaatggcatcgtaaagaccacactcctttacagaagttgcaccgcccatgttgatactgctgcccttcgggatcaattcgagtgctttctttacagcctcttcttttgtctctacataatatgcttccatgttgcgggagttaagtgccgccacaacacgcgctcccagtttttcatttctcatttttcttacgtccattgtgtaaacctcttttccaaatagctacgctatgatttcatactgcatcagctcatatttgagtctgcttccctccataatttccggtggaagcaatgcccgcgccacaagttttaaatcatcactttcaatatctgtccgctttaaatttgcataatctccatcaatgctgaccacttcataataccatgtttccatatgctacctccattttttatttcatataaatctcacagactgcttaaaggcgctacatgaatgtattttttcgcatagctattgattccccggagtaatccggctgctaatttttccatttttttgtcactgtgatccgaacactggttgcccagttcaatatcaacagaaggaattgtactgtatgaagtctgcgtcaggtcaatctccgcagctcctgtcccgcttattttcacttttttagaacgcaatcccttaatcaaagcttttcccagagcatcatgttcttcccaataagaagcaagcggttttcggtttttcagctgtttcggaacagaagcataaaaacatcctttgtcataggaaagtccgtcactgtcccaatgcagtgcaatatgacaatctgctacattattacatataaccgtgcgcgccacattatccaattgcacatcctttccatcccggaccatgagcacatcatacccctctgccagcagtttctttttcagaatccgtgccatacgaagcgtcacatcacgttctgccgttccgtcccgaaatgccattccatctgaaaccgccactgctttcacagagcctgccgctgtcgttcctccggtcacctttgcagagccatccggatgacacagcgttttgaccgatgaaccgcctttcgtcccatgtcccgcattgactgcaatcacaatgtccttccggttctttttcgccttgtacataacggcatagcccgatataattctggcatgatccgcatatttccaggaagagtccagataaattttctccttccccttcgcatatccgcatatcgggaaactgatgaccatcaaaaatacaattagaaatactatcccctttttcatatacactcctctttctaaacattcgacagtttttatccccctgtaggagcaaaatatcttttcactgtctttactctacctcattttttatggtaacacaagataaaatccccgtgtcgttgcatttcagtgcctttaagagtatcattaccatgatacgaattttaggaggctaaatttatgaaattaaaaacaagacaaatcactgttacagcaattttactcgcaatctgcattgtaagccagtttttcaaaaacctgaatgtatacatcacaggcccgatcatcaatgccgctctgattttaaccacggtatacgctggtctggcctgtggcatcattttaagcgtgatcactccaatcacttcctttttcatcaccggaagcccgattatggcagccattcctgcaatgttcccatgtattatgattggaaatatcattctcgttctggcagttgccctgctccgcagtaaattcggtaaaaaagccggtttgcccgtatccattgtaattggcgctgtattaaaggctctgtttatgggaattttgatttctcttatcattctgccgaatatgctcccggcaaaaatgcagccaatgttacatgtcctgcagcttcaattttctgtcacacagttaattaccgctctgatcggcggggtatatgctatcatcattcttgcggtactgcgtaatacctctcttggtgagcaggcgtaatcccacactacataaattaacgccccggcagctacaactaccggggcgttttatgtacctctccaaagtaccagttctttttattttctttgtttactctacatttttcaaagcctgatccatcggaatcttcttgattctctggaaatcaaataccataacaatcagatatccgatcagcacaaatccaaacatttttgcataaccaatcggtgttacgcgaaaagtgaaccagccgctgtaggaaaagagcatcatccgccatgccgcggccataacaagtgttccaagaatcacactgatgagatccgcgattacaaccacaatactcgtcgaaagcagatacagactcgcgatctctttgttttcgtatccaaggatttttgtcatggaaatcgcattttcattcttctcaataatcagtttcgtcagaagatagatcataaccgcagccagaagaatacaaagaatctggaaataattcatgtacgatcccatcgaatggtcaagctgatctgccatctttgtaatatctcttatcgtgatggtcgttgcaatattttcctcatcaatatctgtaatcctgctgtcggataaaaatccactgaattcattttcctttaagtcaaatacttttccgtaattgtcaatcgacataaaaagcgcaagactttgggacttgtcataaaatcccgcaactttaaacttgtaagatttattttcatacttttcatccagcgatacggtatcgccaacggtaagtccatacttgtcagcaaacgaagtggaaatataaacttcatttttcttgagcgaacttaactttttgatctttacatagttgctgttgtccgcgattccatataccgagatctcctcatcaagcacatcactcttttttacgagtgaggtcatgttaaacttttcggcatctttgttttccgttgtaatccgtttattatcgtcatcttcataggatttaagcacatactggtattttgcaaacatcatgccatccgtgttgctcttataataatcgagcgtatccggcatgcccactgccatggcaagcatgaccatgataaagaaaataccgacaaataaaatcaggtaatttgtgacattctggaacatgatccgcaggcggaaccggccaaaaaagctccatcccggcagacgcatggcttttttattctttgtctttttcaggtcatgacgcagaaactgcagtggtgtatgctgcatcatgcgcacgatcacgatcaggttgacaaccagcatcaggatcaccggaaccaccgtagtcttaaagaatgcatccggattccagatcgtgtaatacgttggcagactgtaactgttgtaatacatcgatacaacaatatttttaaacaccgtatagccgagtatatttccgacaatcgcagccagcagtgttacaataaccggcatggacagatagtgccgcaccagctctcccttcgtgtaaccggacgcgcgcagcgttccgatcgcggaggactcttttgcaatcgtattgctgatcgtcacggcaaagataaatgcgatgattaccacaaggatatccagcagcacaccgcccatggctttgtccgatcccatatcatcggttgcaaaattaatcgccggattgccatatttcggtgtgtaatcttcgagctcattgtccgcaacaaccacctgtgtgagcaatgcacgcataaaattatcagagcttgttttttccccggcctcatccgcaggctccgtttcatatttccatgcataagtatagtgaatactcttgtgcagccggtcgaaaccgtcctgtgtcaccattgccacatcaaatttcagtgcatcaaacatcagatctgtggtcttttcatgtaaggtggagtaattgacatacgcaagcagtcccacaaccttataagtctctccggaaactgtgacggtatctcccacctttattccgacattgtcggcgtgcatacggtcaatggcaatttcatccgccttctgtgggaaacttccctgcagcatacatgccaggttgatatcctttgtctttgcaaatacgcggatcgttccatcctttttcccgtcgttattataatcttcttcctcatttcggaaaaagttttcatacaatgttgtctttgttgccttaaaatccgctttttcacctgtctcaattgccgaaagcaaggtggcatctgcctgtttttttaactcaaaatgaccgtcttcctgtttgtattttgtcacgccttcgtttgccgaagtaatcatactctcgtttgccacatacataccggacacaaagccgatcgtgagcacaagaaacaggaatacaaccagatattttttccagtccccgatcagttctttcggtattctcctgatcaggggatttttgatttttttcatagcagcccccttaccattccagatcttccgcggataccttgtttgtattgatgtcgttgtggcgcaccgcaccgtcacggagcttgatcacatggtctgccatatttttgatggcctcgttatgcgttaccataatgatcgtgttgccgtatttttgattgacctcctcgatcagttttaagatttccttggacgtattgtagtcaagtgctcccgttggctcatcgcagagcaggatatccggattttttacaatcgcacggccgatggaaacacgctgctgctggccgccggacaactggttcggcagtttgtagcggtgctcgtaaagtccgagcgtatgtaacagatcatcaatatcaagcgcattgtctgacagatacgctcccacttcgatgttttccttcacgtttagatttccaatcagattgtacatctggaatacatagccgagatgctttctgcggtactgtgtcagctttttctcactcatatcctctaacttatcgccgttgatattgatgtaaccggaatcggcgttatcaatgcctccgatgatattgagcagtgtggattttccggaaccggatggtcctaacaacacacagaactccccttttgcaacggaaaaattcatgccgcgcaggacttcctgacgcgtctgtccgcttccgaatcctttctttaaatctacaatttccaaaaacttcttttcttcttctgacatagaaactccctttctttttggttttatttttcatactaatattagttttatctaacctctggttctttttttaggtctcccgcaaaaagcgaaagacctgtgcttcttttctaaaccttttgtccaaacgcggacgatctgtgcttcttttcccgaccttccgtcaaaacatgcggacagcctacggtctgacgagtccgtaccagcctgccagcagatattttacgcctttttccgcaaaccgcagtgcttcttcctcgtcatccatgtgcgttaccataaatataaacatatcgatctgtgaatgggacatccagtgtacaacgctttgttccaccatcggcacatggtaagctttgcacatcgcttcacagataaatgcattgtgctcatccatctggtcgaccaaccggtccggcatatgttccatgcttgatccctgcgcttttgtcagcactaaaagcacttcatcccggtaggtgtacagttcatggacaacctgtgcgactgcttcaaaatcgctgctgtcatcatgctcttttgccttgccgctctccatctccctgacttcaaaagaaaaatgctcccgcagaatttcattgagccgatccataaaatttcctaccacctcacagaacagatcgtccttgtcctgaaagaaaaaatacagtgcccctgtggtcacacccgccttctggcagattccgcggagagacgcccccacaaaccctttttccataaattcttttttggcacattggatcaggtgtatcttcgtctcgctgtcatgtattttttttcctgccatggtacgctccctgtaaataaaaatgtaacataacgttgttatgttagataacaccgttatgttacatcattcccatgtctatgtcaatagaaaaacttatgcatttttctgtttgtgtttatcataagctgcaaacatgccggcaagcagtgttccggaaatagaatgccaggtgcaggaaactgcgcagatgatcgcagactccggtgttgcggaaaactgtgcggtcgttgtggcaaggtttgttgccagtcccgcattctgcatgccaacttcgatggcaatggttctctttttggcggtattcatgccaacaagttttcctgctccataaccaagcagataaccaagtccattgtgaagaaaaacagctacaaagattacagctccggactggaagaacttcgcgccctgggaagataccacaccaccgacaacacacgccagccccagtactgccacacccggcataattttctgtaactcactgaacattttctttttccccagcagatagtttaaaaggaagcccagtgctaccggaagaataaccgtttccacaatggaaacaagcattggcagtgccttgatggaaatattggttccgcttgccagaagagaaaccataagtggtgtcatgatcggggaaagaatcgtggatacggttgtcattcccacggaaaatgccacatctccaccacagagatacgacatgatattggatgacacgccgcccggacaacaacctaccagaatgagtcccagtgcaatgccggcaggaagatgcagcactttcgtcagtgcgaatgccagaaacggcataatcagatactgtgccagtgcaccaacacagatatcgaatggtctctgtgccagaatcttaaaatcctgcgttgtcagtgtcagacccatactgaacataataataccgatgatgatcgactgacttgtaaacttattggaaaccggatcggtaaataactgatggtttacccatcccatcatttccggaacgataaatgttactaccgcaattgcaattaccacaattgatgtgtagtccgataaccatttgctgagtttttgtagtgctttcataaacttttcctccttggtctgttcactgaaaaacgaattcagacattaaaaaagccccttcccagatactactctggaaagggacgaataaaatccgcgttaccaccctgattccacagaaaaactctgtgacacttcacataccaacatatgctatcccataacggaggaaaccggcgaagtttactcacagttgtctgctttcagcccgcttcttagagaggatcatccatatccggctactacctgttcgcaccacccacaggctctctgaaaataacgataagatacgatgctgttctcgtcaacgaatttcggtgaacaatattttctttatgttgcctattatagactcctgacaaaatatgtcaagagaaaaattttccatcatctgcttttctgattgacctccacgtttgttcttatggaccatacattacatctttttctctatatgtccccacaacttttcatcagtctttttcaaaatgctggtaatccttcgaatgtgtccagtccccaccccaggtaaatccatatcgggtaaaaagcttgtaacacagatcatcgtgatcgatcttgtgcggaaaatccccactccggtcaacatacgcttctgcgtttgcaggctcaatcgacagctttccgttgacggtttttacataggggttataaagtgtattgatgtcaactgccatgcccagaccgtgttttgagattgttgtcgtgtgggaaatgaaacggaaattaaacgcagaggaattgttatcgctcatggatgcctcatcatccgcatcgtattcatccaccagccggactttttcaatgggatattctgcctcatacaactgcctgaaaatggcaaggacatcctctgcaatggctttatttaccacaagttctccctcttttgtctgaccgtcaaaccccatgtggagcacatgaagatagcggagatcttcccgcggtacggtacaatctgccttgtatgattttccctgcatcttctcaaaaatgtcgtccgggattttggaaatgtagaacgcttcctctgtgatacttttcccggtacggtccgcattttcaacactttgttctttctgcgtatgatccggttcgttcatgttttgttttttctcactcagttctgtccctgaagtcctgtgatcctgttctttttcactgttctcctgatccgcaacctcagacttttttgtgcttgatttttccggatgccggatcagacggcttccggttacgactgcggcggctgcaagtaacacggccgcagtaatgatcattcctttttgttttttcaccagtttctccttactgacacgtttcccttttctgtaaacataaaaattcatccgcttcaacatgataacaccgctaagcctacgctatcgaaaaaagtgtcatgtgaaagcccgaaggccgcatttctgcacggatgaattgtgtatattttagcactgatttttgggatttgctatattttcataacaaaaaatgcatttttcttttaatgcaccctcgaaaaataatccatcagaattcccttaatatgattataccttctggcataagaattctccacccgtataatctccatattgtgtgcctcacagatggcatttttcttccggtcgcgctcctgcaccaccgcatcctcaaaatgctctttcccgtcaagttcgattgccagaaccggcagttccttttttccctgcttttcgtacacaacaaaatcaaagcgccccatataaaacagatcatcatatgtcatgttgtcctgaaacacctgcgatatggcaacttctttgtgaatcacatacttactctgggaaagccagatattttcgagcgcatgcgtcaggttttcaagaaatgcattttcggtagcagtagaaaacggctggatgccaagtgcacgggaactgatatgtttttccgtgatctctgacttcccgttggttttgatgtactgcgcaagttcataaagatcatcgtctgcctgtcctgcatgcagacgctccagttctttgctgtctgcgagcagaacaagtttgtctttcgcccgtgaggttgcaacattgatcagttccttattgtttttcagccactgataggtaccggcattggtgcggtcggacagtgccgtggaaaaaagcaccacatccttttcatctccctgaaaagcatgcaccgttccacagactaaattttcgaggtggttttctttgatcgcctgctcgatcagtgcccgctggtttacaaacggtgtgatcaccgcgatacttttgtccgtgttctgcttcgcgtatgcaatgacctcgtctgcttccgccggagatgtatttttgatctcggcacgatcgctttttacatctacatagacaagcggctccggctctttgctttttgaacagatctgcagtttggaattgtaatattttttattgttaaatccaataatttctctgttgcagcggtaatggctgcgcaaaagcacttcatcactcaccgcatcacatgccagatacgttttgtaaaccgaattctttctgtaatcatattcttctgccacatgatatcgccgtcgcagcttgcggttggtcagttctccgagcagaataaccggattcagctgctgcggatctcccacaagcatcagtttctctccacggataatcgggacaagagagatcgcaacgttacactggctggcctcgtccataatagtcatgtcaaacaacggctccggttccccgatcttatgtgccgatatgcaggtagtgataatgattggaaaaacacgctgcagcttctttacattttcggatttctgcatgtatttgttgaatgcccgcgcctgtgtctctggattttctccagaatctaaaatctcccgcagttcctgatatttgggttcttcgagtgtcttgatataacgcgcagacgtataaaataaatactgataaaattcttcttcgttgcggtcgagaagctgcagagcatccgaatcggaaatttcgccaatctggtggattctctgatcgagcctctgcatctggtatccctgcaggtccatctgaaacgggagcaggttcatggcatttttgatatgttcctgatattccatcagatgcgaaagtgtctctttccgctcctttaaatccagaatttcctcatactctttcagtctcgcagaaagacgttttgcacggtcaacccggtcatccttgcgcttatcgagcgtggatgtatatatttttacggtctgcacctgattgcgcaggcggttgatgtagctgattgcagctttaactttgtctatatttccaagccgcagtaccggaaacggaatggtctgtccatggtactcaagatgtgtcagtttttcaaatacattgtcgattggaacgttattgtaggacgcaaataaaacggtcgtattgttaaaaaacgccgttattatcgtgttgatgatcgtatttgtttttcccgtgcccggtggcccctgtatgtaggcaagcggatatttcatggcgttgttgatcgccagcagctgatccagattgatgttctgattgatcagtgcaatcggatacgccttggtgcggcgcggccgttctaacaattccccgaagaaggctttgactggataagtaacctgctgcttttcaaacatatcaagtatggctttgtactcgtcatgcagattcagcactacatccatcccaagccccagcacatacggcatatcatctacgaccggcttttgcccgccatgaccggtaatcgcatctttgattttttccagattgttttcaaaatcttccagcagttcgtactcgtccgcatccagaaatttacgcgcattttctgtctgtccgtcaatgccaaactgtgtgcagactgtgatatcttcatccggctgaaacactctgtttttcacatcaaggttcaggttccggtatgccagaacatatagccccttcgccgtgtgaatactcaatacattgagtgccagtttcttaattcttaaattggtgctctttttcttttcgtgagacagggaatactggaaatttgacacgacctcctgaaactgctgatcgttaagtgcataccgtccgtttttcacacgatccccatcgatataatggatcagatcataatcggtgatgtaaggtgtcgtatccatgcggttacacagttccagataatttagtattttcagatttgcagagctggaaaaaatagttttataacgctccggatgcatctcgatatcttcgatcagctgcctgttttccggacagtacgttccttcaaggacttccgtggacagaatggaatccacaaaaattttgtcatattcccccagtgtatacattccgaggtgcagaccatctactttgagggtacgttttgccggatcaagatcacggattccaatccagtattttgtaatctgatccgctttgttccgatattcgattttcagccactttccctcatgaatcgcccggaaaatgtccctgcaaatctgattcatactatgctccgtcctgttttacatgatatctctatcattcattatgatgttcggacagaacctttgtcaagcaaatcctcaattccccttgctgctcaaaggattacttcttgtttcaaaaaactgattgttatctatgcgtgcgcggtttttgtcgttgtacatactgctctgccggattgcggcattttctttttcctgttccggtgtgttctccgcaaaatgttttggtcctgcggtaaccggatctgcatccgttcctacaagcatcgctgatttatccgtataatttttgggtttcatgacatacctccaacttttttgttagtatgtccgttctttatcctctccactctcgtaagtaaaagtttgtaaaaacttccgtaaccgttctgtcttcggattctcgaaaaattctttcttaaatcttattctaatggaatatcgtactctttctcaattcgtccgacatcgtttccagatgactttttactgttcttgcaatgatttcatcatcttccacgataaaaatgcgatacatcgatttagtatctgccacgcaaccgctgctgttcgccttcttctcctgatacagaaaaagataatcagcacagcaataatcaccaaataacttcccattgcctgtcctcctgcgtttccatcatgaaatcttatttcctgcctttgaatactttaacgcttccttgcaatatacagactgatttacaatccaaatcaggcacactacaagagaaggtaagaatcctatgcccaaaacaagtgcacagacggcaagcacaatggacagaatcgtacaaaccgtgtttgtggaggcgtaagctttaacctcaaaatcataatcatccgtgtggagatgcgaaactgaacagaagattttctatgcaggatgaggcagagcaaaaattgacagggagcagacaaatgagcttgaatatgccgatgaatcgcagaaagaggagaactcagacagacagccggtaagaaatcctgagagggagaagccggagtaggaggataaagataaacgtttaagtggtacatggactttggaacaatataaaggacagtatagatccgctatgtatgcagcagtgaaagcccaccgggaacatcacccaacgggtctgttcccgacctcacggtcagatacatatgaatagttgtgtttatcctgctaacactaatggtatatccattgacttcataacaaaatttgtgtataattttgttatggaatgaggaggtgtttttatgccagcaatcaaatcaagtgctgatttaaggaataattacaatgaaatttctacattttgtcataattatcctgaaccagttttcatcacaaagaatggaaaaggcgaccttgccgtcatgagcattgaaacctacgaagaactgaccagccgctttgaactttacagccagatcaaggaaggaatggacgatattgccacaggcaacaccagaccattttccgaagctatggctgatatcaggagccgccgcagccgatgagctatcagattcatatcacttccaccgcagaacacgatattatgcgtgctgcggattacatcgaatttaccctcagaaatcccgatgccgcagataatctgttagatgctgtgactgaacagataggctcactagccgacctgccacagaagttttgtctggtagatgatccggtactgacaagctggggcattcgttttgcgataatcaataattaccttgccttttatacgattgatgaagaaaagcagactgtaatcatagtccgatttctctatcagaaaagtaactggacttccattcttcgacagggatagccctggtgttacacaacactagggctatctttttactaatattttacgtagaatacttctcattaagtaaattccactgatccaaaaagtatttcacaccacctcttccacagagttcgtgtcgtttcagcacctcgcctaatcttagaactaaatcctccgcttttttcatctgatattgcatcacacgatcctttatatattccacatttgaataaatctttggttccgtgtttgaagcacgattttgctttattaaattcatctgcatctgtcagaatcaagcttactttaattccatttttcaatggagaatcaatgtatgctgccccaaacaaccatgacaatttatgcatcaatggtctgtgatgtcctacatatacatcaaacgcccattttgtaacgccttcgaatgcatctgtttctattgagaaatccgctgcgtatcttaattcttttgtgctcaaaatgatgttatcccgaaagttatactctacattgtaattcgctttatagcccttgctatgcaaatcaaataccataatatctctgcaaagctcttcgatcattgcttgtctattcttaaagtgctttgatgcctctttaacaatctcagatgtgtcttctggaacaataccatcttcaactctaacttttgccaagccatgcgctgaaagaatcatatcctctgtaacttcactatttggatcaatattttcgataatctttgaaataagtgaatctgaattcggcttattatttttcttgttgattagtctggaaagcgtcgatgtacttacaccgcagtccttcgcaaaatcatttagagaacgatcttctccttttgccaaaattgtataagctgataagagctccatatttggatcactcactcttatgtaatctgggaaaggatttactttcgctagcttcttctgttgcatacagctcacctccatgcaataattatagcattgttgttgttgcgtgttgtcaatgttcacgcaacattttatttccactttgtaacttcatgaacatttgggatattcagccaattcatcaaacgcagtaaattcgtaccatctggtgtagtttctccgctttcccacttctggtatgttcgtacattagctccaattgcatccgcaacctcctgctgcttcaatcccaaaacgtttctataatttttcagagcctcataatcaaactctgttgccatcggtcctgtgtatgctcttacccaacaatcatcgtcattctctaattcgcactgtacatcaaaggcatcaatcaccgtttcaggcgtaatctgaacatataaaattcctttctttgacttctcgcatgtgcagaatatattttttgcattttttattctcaagctgatccattccataattggattgccatcctcatcacatgggaaaattccagggaattccaatcgcatatcatttcgtacaaacattccatctcttatatcatacaaaatattatagatttcaggctctttacctgctgctattaatgctcggttgaattccgtaattaaacgatctggcataatatccgactctaatttatagtcatctcgaatatgaagataatctacccacatcgtgaataatccactctcaatatgccctgcctggtgaagtgtataattaaaaatgtccttcaaagatattttcttttcatagaataaatatctgaggtcttgataaaaatcttcaagcaaatccaaagatttatatactcccagctgttgctcttgtaccctcaattctccaaacaaccaatcaaggcatccaccatcatgataatcatctatatctggcatataaaaataaaatggcattcgatctataaatgattctttgtgtaatggataatagccactatccgagtccaagtatctactatgcgcttgtttgcctccaggtaatgacttcttatctacataatcgaaaatctctgtacccaccatttggtgcattgaaagatactgtaaaagtttatccttatcgtaatatctgtcatctacatactgatctataatttttctcaattctgcattatccatgatcctgcctccttataaggatattatatacgcattttctgggtaattaaacagaaaatattttcgtaaaaatcaatacatcttgcacacattatcataatttacccatttttttcgtgtatttggaaaattcagcattaaatcacccgaacaatgattcgtatcgattcctaaatgaagcatcctacaactggagccgttttctgatgcttcctgcagtaaaagtgatctccgcttttgacaggcttacacgtccggaaagggtaaacgttctgattctggacgactcagtgatcaagcgtaaccgcagtaaaaaagcagaactgctggcacgcgtttatgaccatgtggaacataagttccagaaaggttttaccctgcttacgcttggctggtcagacgggtacagttttatcccgacaggtttcaatctgctgtcttcagcctctgaaagcaaccgttataatgaagtttcagataacattgaccaccggacaaacatctataagttccgtaaatcaagtatgatgcataaaacggatgctgccatccagcttatccggaatgcgctcactgtcggaataaaggctgattatgttcttatggatacctggtttaccacagagccaatgcttaaaaacattctggatataggaatccatgcaatcggcatggtaaagcagctgaaacaacgttatacctataatggcagacaatatacgcttccagggctgaaaaaattcgttgatttttccggtgccggaaatatctttggttcccttattgttacgaccaaaaccgggattccggttaagattgtatttgtacgcaaccgtaataaaaaagtgaatgctttttcaaggcatcaaaatccttcctgaaattaggttcgggattccagagccgtagttatggtgcaatggtaagccatacaaccattgtatttacacgatatatcattctggaatggatccgcagaaaccagaatgaccagaaaagttatggtgaactgtttttcatgtactgtgaggatatccagaacatggatttaaccaatgcactgcagagccttatggctctgtttgtggaacatatgtcaacgctttctgcagatatcacatctgtactgaaaagtaaagtaaccgaatggattgcatcccaagccagatttattcaggctttactcgaaagtatctgctgggaaagttgagttattaaattatcttgattcaacacactcttgatatcgaatcgtactcttccataggctgatgtttctgtaacaagctcaccttttggatttctcacacttcccaccgatccaatggaaacagtcctgtttcctcctggctcgttgtagcttgtaacctttactattccctcttctatctcgtaacaaatgtactgatcaaaggaaaaattgtaatacatccctgttgctccttacattaagtacttggggcaaaaataaagctgattacaaaaaatgcgaaaaaatctccaaaaacttttttcgttcttggagattccttgattttgttagagttttagcctgttttctagcaaattactttattctgtttttcttcttgtaccattccctaccccctagccccctatgcccgaactcccaaggggggaacactaagtatttagatacaattttaaaacggcacacgcgtgtgccgttttattcacactcatatttttttatgatccttgcctcaatatcttctgctgttggtaatgcttcttgcagctcatttggaagatcatcaaataacttgtattcgctaacaccaatcggcttagtcatatcttttaaagcatactctgctactaaccgattctcatttttacacaaaataagtcccactgatggattgtccaactcactcttaacttcgttatccaatgctgataaataaaaattcatcttacccgccatttctggtgtgaactctcctgtttttaaatcaacagctacaaaacaatgcaatttaaaattgtaaaaaaggagatctatgtaaaaatccctttccccaacattcaattcatattgctccccaacaaacgcaaatcccgttccaagttctaataaaagctttctcacattggcaacaagttccgattcaatatccctctcaatcattccttccctaaatcttacaaagtcaaagatatatggatctttcattgtctgtaaagcaagttcactctgttcacttggcaataccccattaaaattttgcagcttaggagtctcaacttgtctggaatataaatcataatccagttgcatttttagtgtattatgtgaccatccgttctgaatggtcttctccgcataccaaatatatgcctccttggtctttgccttacccataagtgctttgtgatgataccaagttattcctgccaatccatattcatcaatatcatcttcttcaaatattgatgcaaattttttcatatctcttaaatttcgaaccgaataacctgttgaatctggaaattcacttttaatatcttttgacagattatctaaaaattttgttccccaattattattttcattgataaatgtaccgattctccagtttctatgcaacaatgttaaatttgcatctaccacaactttatattgactcgttttaatgcaatctataattttatgaaatagttctaagtactcatcattatttatcagcatacaattcctcctattgtaattcggcacatgcgtgtgccgaattgaaaaacacaaaaattctatattacctaataatttaattgttctgcattaacaaaccactctggcttaatctcagcatcgtcagataatctcaaaattaaattatcatcacaaacaaatgatccatctctccaattatcatataaccttaatattgccttttcaagaaataccctagttttttcttgtattgaatcaggtggataattcatgtcaaatatcacttcagaaagcggaattaaatattcaatgcaataatacttactattttcataatactctcttgccattccatcaatatttaaaagccattctatattttgaaccaattctgggcaatatgctagagttgaaaaataagaattttgttccaaatgtgatctaaatacaaatccattaacacaaaaatcttgcactttattatagcttagcctagatctaagatagtacatattccctctatcatataaatactcattatgaagtggttgtatcattcccttgtaatacatatctatatgcccttcattatctgtaaaagtcactttatatttgcggaagaacatagataatggcgagctctccaataataattgtttcaagttctgatttacatgaatgtctgtgccatctagtcttcgtgacaaatggtacatttgtatatattcgagttcctcgtccacaatataatctgacaaaaaatcctcaacccatttccaaggttctttttctgtatccgaatatatggaatcaaacatttgtatcatgtcgccctttgtaatatttaatactttcatcacaccttgatttagcgattccatatttctcgcatctatatatttcaattttttacctaatccttgtttttacctaattataccacgcattctatatatcggacagtaaaaaggagcagcttatactgcccctctattaccttcctctgtgtcttctcattggcacattttcctgttcaagattttctaatgccttctcaaaggaattcaccagattatcaaccatcacatgtattggtaacatcaacataatcctatgcagcagcttcatcaaaatatactatttttaggaactctgttttctcaatgttattatttttcaatttctctgcttactatttctgttcctcgcacaatttctgataccttttcatcagttctgcgacacaggcagcttcgcttttataagcttcactgccttttgtgaatccgtatgcctgcatgactgccatatcattctggcgatgtgcttttcgcagttccggcggcatggtcagttcatcataaagatctgcaaggctgctatccggatataatgctctggcatcaaggattgcctgtgcagtctgttcgatttttttccgttgctgatcggtcggctctggccatggaaatgtattatataccacattacttgcataactataatcgctctttaatctgccacaaactgttcgcatccacgccatatgaacattcgatgtcaatacaccaaaaagatacagagaaatgtccggtatcaaaaacaatttacttccagcaataacatcagcatcgattacttccatcggaatatatcttcgattttgtgaagatactttcggtaatgctaacgccggatttattctgtcttcgctataatatcggagtcgaactggaaatgtcggcttgtcagcataatgattagtatcaggacttggacaacttaatcgaaattcacgaacgttctttacacgttccataattttaggatatttttttaactccgatggcaatatatctttcagccaaaggcaatatctcgattttctcgcaataaaatcttttcccatcatataaggatgtatatatttttccgcctgcggctcattttgtagaaatgtatttttttcatcttccgtcataacatagtttccatcgtctttcatctcacagccaatatacattttaggtacatcagaaattggcgtttttctacttacaatgaaaacattatccgcatcaacaagatatggatttatattttttgctaatgtcattcttccatcagagaatattttctttacatttccacccacctggctaaatccgactattacgcaatgtacatgtgcctttaaactagcttcgctatcccactgaaaagttctatgtgcaaaatcaattttcacacctgctttaaaaagtggttcccataaatttgcaacttgttcaccctgacatattgaattggtagaaacataggcacaatgtatcaacgtattattaataaaatctgcggctttcttataccagcaagaaacgtagtccaaggttccatagtttttccaatctgataaaactaattttgcatcctttttctgctcagtgttcatatttttagttcctacaaatggtgggttacccatgatataagatagctgcattttaggaacaatactttcccagtccagttttagtgcattgccttctacaataaatgcattggtcgtcaacggcagaaaatcaagattcatatgaacgatatcttctgtctctttcatcatctgggattctgcaatccacaatgcagtcttggcaactgtaacagcaaaatcattaatctcaattccataaaactgatcaatagaaacatgaatcggggaagattcattaaagccaaaagtaatctgtcctctctgcaattcttttatgacttcattctccaatcgccggatactgatatatgtctctgtaaggaagtttccacttcccgatgccggatcaagccaccggagatttgccaacttcgtctggaaatctctcagctttttatcttttgttctctgaacggttatctgctgaatttctttcagcttatttttcaattcgtccaaaaacagcggatcaatgactttatgaatattttcaatgctggtgtagtgcataccgccggagcgtcttgtctctggattcaacgtactctcaaacacagcaccaaatatagtcggactgatttctgaccagtcaaaatctgctgatgctttctctaacaataaattcctgatttcatctgtaaacggtggaatctcaatatcttcatttgcaaaaagtccaccattcacatacggaaaagctgcaagctgcgggttatcatctttcagataaggatctctgtcctccagctttgtatcaagaatctggaaaagttcaatcatcgcttttctcatttttcttgcatcaaattcttccagataatcatggaacatgccatgctggccaaaaatgcccgcatcctctgcataaagacagaataccattctgacacaaaggatattcaggcttttcattgcacgctctgttgttggatcgacatattgttttgccagtgcatcatacagcagccctacaatctcacctgcggcaatggaaacttccatttctctctgaagatttgtgttttcctcgtccacaaggaactgtaaccgataatattctttttccagattctccaactggataatctccggatcaccgcccggcttttccatgtcataaatataaaatgactgaaaattgctggttacaatccatcttggtctttttgaatatggcagttcagaagaatatctttttgcctgttcaaagggtgtcagcatagaaccatcagactgccggatagcagccgtcaggctcttgttgatacttttctgttcaatcatgacatgagttttctcaatatacccgtcaataaaactggcgtgatcaagatgtacctgatcctcaaaggaaataaactgtgatatttcagttacgccaaataccgttgtcagaagctccacccagaaaatctggctatctcccttttcatatccacgatctttccagttttttgcaaatgctttcgctgctgctctttgttgtgcatctatcattgtggcaccctcctgttacttttcatctgtaaactccatcatctcatcaacggtgcagtccagcttcttgcagattttctcaatcgtttccattgagacatactgattttttcccattcgagcaagaatattaccactgatcccggtaaggtactgcatctctatccgcttcatatttttatctatgagcattttccataatctgttataacttacgcccataaacgcctccaaatttttcatctaaacatattttgattatatcacgatttcattaggttaaatacctgtaatttttgatatcttctacaaaacggaaaagaggctgtcctgacacaagacaacctctccaaccatttacttcgggttagtcaaatggaagctcaccatctagtacttccatgaatccgtctttatctcctaaaatgaaattttaaattccactgccctacagggcggtagaatttagtcctgcacagtagatatttactctttcatacatcagtgttattgtaaaagttccttctgacaacagtagaaggagaattatcatgagtaaatatatccctggaaaccagaaacatctaacacttaatgaccgtatctacatcgaaaacgaattatccaaaggtgcgacttttaaagacattgcggcattcctttgtaaagatcctacaaccatctcaaaagaggttaaatcacgacgcctttctgactggtaccacaaaggaactttctacaatgccaaaaacttttgtgtacaccgctatcactgtaaaaaaacaaatgcctgtggaaaaatcatgctctgcggtattaaatgtacatcctgtccaacctgcaaccaaacctgtaaggatttcgaaaaggaacggtgctgcagacttgataaggcgccttatgtatgtaatggctgtccaatgaaaatcaatcattgtaccattgcccataaataccgctatgatgcccgttttgccgaccgtaagtaccgcgaattattaagtagttcccgtgccgggataaatatgacccggcatcagctgcaccaaaaagaccagattgttactccgttgatcgcacagggacagtcaccctatcagatcctgatcaatcatccggaactggatatgtctgtccgctccatgtacacatacatcgataagggactgttcacagccagaaatgtggatctgaaaaggcaggcaaaattcaaaccaagaaagtgccacaaaacacagatcaaagaccgcgaagtatttaccaacagaacctatgcagacttctgttctttggaattaaattcttatgtacaaatggacacagtaaagtcatcaagggactcccagaaaacgctgttaaccatgattctttacagaggaaaaactgtttcttgcatttcttattaaccggtgcacaaaaggtgccgtccgtgctgtatttgaccgtttggaaaaacgtatgggaacgtatgaatttacatctgtttttgaaaatatcttaaccgaccgtggctctgaatttgggaacccagaagaattagaaactggaattaccggcatacaaagaagcagcatttattactgtgatccaatgcgtagcggacaaaaaggaaccatcgaacaggcgcataccatgctccgcatgatattgcctaaaggaacatcctttgaatttctaacccaatgggatgtcaatcttattgtgaatcacataaactctactccaagagaaagccttggtggcaaaacgccgtatgatgctgccctggaaacacttggagaagatgttcttaaagcctttcagctcaagccgatttcaccagatgaagtcaatttaacgcctaagctgatacgctttaagaagtaactaattaactgatcgaaatctgctgtcagactggaagtaaacatttcacattttttaaatgtggctggtggaatttagtctgacacaccgaattccagtagcctgtttttcatgccataaaaacaacaaaatttcgataagctagcttaattataacagaaagcaagagattttgttaaaaaactcctgcaaaatcagcaaaatttaaaagccgatggaatttactcttgcactggaatttactttttcaagtcagcagcaatatctttttgaaaatcaatccaaatacaaaaggatgtatcacgataattcttgcattaccttgacgcatcctttcgtgttgtattttttattcttcttaatgacagctatgacttccacatccatgctcgccacatgtatgtccttccccgtggttatgctcatggtgagaacacttcacatccggattatactcaagtgtttcattgataaaagcttctaccgctttatctgcatctccggaaactcctccgaaaagattaataccggctgccgctaacgctgtctgtgcaccgcctccgattccgccacagatcaaaacatctgcgttcaatgcattaagaactcctgccaatgcgccatgtccgtttccattcgtatctactacttctgaatgtactacttttccttcctctacatcgtaaatcttaaatgtctctgtgtgtccaaagtgctggaaaatctgtccattttcatatgttactgctattctcatgataccttctcctttttcttctgcatattttttgtaaatttcctgtttgtaacatcctccaaagctgcagttgctgctctgaccatcacaaattctgaaatccccgccctcgattctgagtggatgtccatcaatgagtgcatctgctattttcttcctggcaatctcgtaaattcgttgaacagttgttcttgcgatctgcatagctgctgcacactgctcctgactataaccattcttgtccaaaagacgaattgtctcgtactcatctattgtcagaacaatgggtgtttttttctcattatcatctgccggaagaaattctaaaatttggggaaaatgacagacttttctgcattttactggtctcggcataaactgctcctttctcgcttttcttatataatagtcctataaaaggcatatgtcaataatattattgacatatgccttttataaatcaccttatagtattacttattttcattattttttaatttacagataccctgcgtcattgttcccattgggcagaatgtacaccaggttttctacagtactatgggattgtccgaccacctaccattcatttgaaatactccgttttcagttgcaatttcatactcttcttcgagaaatggcaggttctccccagttgatgtgtattcataatgtaaaacatgattggttctctgactccgcagtgccacataacactcgccatatcgcattacatgatattgtcttccgcaccagttaagacgtcgaccgactgaagttaacgtttcgaagctcaatcactattcaaccctgctttcttgctgtctacgcttgtcagatgccgttaccggcatcatcccaagactcgctattatctggttggctaaaccctggataaaccggaatcccaccggcttgactacacacccttagctgggcgcacaactggaagttaaccaattcattgtcttgaaacatcaatcgcactctattcaatcaacatatcagatattgatatccttccattttcaccgaaatcattctctgtcttttcaaaatcataaatcaaaagttcaggtttatttctaacacattcttttatacactgacccgattttccaaggaccattgtcggagccgtttgaaatggtgaaatagcatttacagaaatagtggtagtaacattttcaactgctcgagtttgtaagtgtcctttaatcatgttatatctttcgttatcatctatatctgctacatcataaaatagaactagatttatatctgtatttcttttgtatagttctcgaaagaattcaggaaatctgatttcaaaacaaattcttattccaaattttatcccttccatttcaaatattccattgttactgccttttgtgaaattatccttatcccatccccacaaggcacgcttatcatagaactcaatttgactattaggctgaaacaacattgctctattgtatatttctttttctttaaatatagttccaataataaaggaaatgtcatttttgttagctattgattgaagtttatcacacattatctgaacaagattaaaatcaacacatgacgcattagatatatttctcggaggataccctgttaatgaacattctggaaatataagcaaccgaacattttcagtttttgcgatatatattgctttttctatttctttataattctcactaatatttccagatacagcaaattgatacgcagcaattctcatttaacaatcatctcctctctacaaataacgattgaacaaaatcgctacgcgatggcctgccaaggctgtgacgcagttttatttttattgaaaaagcagtagaattactttccataatccgttattgttaagttaccacacgaaacaactgaactaagaaagctccactgcctatgataagaataacattttccagtctcttccgcaatcggaattatgatgctaatgcacctccgaataggtagatgtaattattaacactaagaagatgaagttcttcatcctctgaatccttaagattgtttactgctgaaagtaacataccacaagattcaattcccatcatctttctaggtggaagatttgtgatggcaataagtgtctttccaacaagctcttctggctcataataagcgtggattccgcttaaaatagtgcggtctgtgcctgttccgtcatctaaagtaaactgtaataatttctttgacttaggaaccatcctccttacaaactccatatgtttttcttttaaattctgcttatgggaacgagcaatcagaagtctttcttcattgtccatcactacttcatctcgtgcagtaaattttccaatcggggaaggcggaatcatgcgttgtccaaacgggaaaagcttttatcttcagtatcgaaaaaacgtaaaagggaacaagtatgggcgtcaggaagaagtgtatcagtgtgaagattgctccggctgtccatatgcagaacaatgtaaaaagacagataaaaaccgtactgtacggatcaaccgcgaacttacagcgatgcatcaggaagtgatagaaaatctcgaaagcatccagggagcgcttctaaggatgaacagatccattcaggcagaaggtacctttggtatcatgaaaaacgaccggtggtacaaaagaattgtccgaagaggaataaaatctgtattgcttgaagtatttctcgtttctatcggacacaatctttataaatatcacaacaaacagaaaaaagttgcagctgccgcataagatttcataatatcattcttatggggtaaggggaactatacccttttttatgtaatatagctattattataactataagcaaaaggacgaatgaaaaaactctcgttttttcacacgccctttttatttcttttctacatgattttgaggttcttctccactgcctgtcaaccaacatattctataactgtaaggcgtgtctactattttcatctcctcagattccgtccatacactttgtatactattgtctgttataataccccaatcaatccataaactctcattatcatcataaaaaaaactgcacaaatatccaggattatataaatttaacttcccgctcgttctcaatatttgatatcctatccatttattctttaacaaagcacaagaaatatatccattatcttcaagaaaaaaaacaacctcataattttctgaaaaattatcgtgatacaaaatctctgtcgcactttcataattgcttaaaaagtaatcttctatcgttttgcttttcgtaaggctaacaatagccaatataacaataataatcgctataacccatatcttatatcttttcaaagtatatcctatatttttcattgcaaccacctctttcttttacttcatattatctcattgagctacattataatcaagtgcttttgaaaagatttcaccgaaaaaaatacggaatagtgggcggctatctatcaaattcttgtatgttgctttaccgcacatgagcattccctcaaggattgttgcaagtaaatctatcggttttagtccactctgcttgtttcttgaaaccgcctttagaccagacgtaataataccttttctgtctggtgacacctcagatgtatactttttcataagcttattaaaaccttctgatttattttgaaactgtccatttttaaaatcttcataagcctgctctgctatttgctttttgtattctacattgctagtgttacttttcttttttgaaaacacatatttatcattaaaatccggtaaatgtattccacctatgctatttgttcccgaaaactttcgctgttgcaatgaaatactgttcaaatttacattcattgaaatcacctcctcaaatagcagcagaaccacgcagggttaaaactcatcatcccactctattgttatagatggttgatacgattttgttccagaacttaaagaactcatattggttgcattaaatgaaatcgtatatgtaccatttgctgctgaagcaagaaatttgctcgttgtcaacgttttatttgcctgcccagtccacgcaatttgttctgttcgtccatttgaacttgaaattgtcaagtagttacatacaattgctcctcccgaataagtcattgatccggtgttcacagttaattttgtaataatagcatcttctggtaaatcagaaaccctaatagtgacagtattagaatttcctctttgtcccggattaagagttattgtcatttttgaagctgccttatatgtacgacttccagttgcagcaaatgccgtcattgaagttgtcaacattaaagccataaccatcatcattgctaaaattctttttactacgttttttgttttcatattaagctccttaccattttattatttttctaatttaatgcttgttttaaacaatatcgccaatcttttcaaataataattgacaataattatgcataccttgatttccgcttctcaaaacagaacaaaacaaagattttatatctatatttcctcctattttcccatattgctccagataaagtgaacgaaactctaaatacgaatcctgaatatagtcacatacctgatttatatcaaaagtatcaaacgattcatccaattttacattctgaaatttttgcctgttttctgcgttttgcttttgacttttagcaaccatttgatcccattttatcagttcctcaaaacctttatttagcttttccaattcttcatccattgttagcaaacgtctttttccgctctctgaatcatcgcatgtatacacttttcttgtctcgttactgtatccttctacaattttttgatacatagtagaataagcgtatgcagctcctgctccaatatcatcaaatccatatgaatattttgcaacttacagtcgaaatatcaaaatcccttcaaactaatacataatttcttcaattatatttactacataaaaattatcgtatcctttttttaatatttaatatcccttgcagaaagtaacctgtttttgcagaaaatgaccatcaaaacaaaaaatcctcttgaaacaaacctaagttcaattcaagaggacttttccctatcggctttttccgctctttgcaggctcattctttgttgcattatccttaatcattgttttctctgcttgctgaaaatacaaatgtcaaaaaaatattgcttgaatataaaaacatatattcatcagaaatcaatctaatcatttttttgtaaacccatcaggcactcctttgtcagatcaaacagtacggagaatgattaacaaatacacttctcttgctgctattgaacagcatattacacctcatatgttccgtcgtacatttgcaagctcactgttagatgcagatgttgacattcgatatattcaggaaatgcttggtcatagttctatcaatacaactcagatttacactcatgtcactatggcaaagcaaaaaaacatattaacaacaaaacatccacgaaataagtttaatttttaacctctggtctaccttagctgactgataatacatgattatcagtcagttgtctttaaatcaaattctaatatcaaaaaataacaattgatggaaataagtatcaggttaatcgtggaatacgcagagccttcacgctccaatagctccctgtactgtataaccagctcctttgttatctcatttccatccacatatttcaaaaattttttgacatatctggtatagctttcaatcgttgatttcgatttttctttatctgtcaggtatcccacaaatgttgctaggtgctcattcatttttatctactcccctcgcacaattatattattacgcaattacgtgtgtcatttattataaaatgccacatgtatataaccaatctgcagtagcgatgacaatagtgtagaatcaataaaatagggacgcaggatattctcccacgccccaattactatctggctttatcttctcttaccttcgatactttctctgctgtccccactttcacatcggcaccacctctagcctcaaatgcatcggcattatactgatactcatgtgcttcagccaccattggagtatacacaatctcagcattgactctctccggctctgcttctgccctgtcaggtacattctgcttctcactcttcgtattctccacacgcttttccttatctatctgcacattcatcgccagattatccagcttatcaatcgaagcgtccagatgcagctccattgatacaagcagttttctcactgctttcataggggtaagtaccgcctttgtgagagggtgtttctgttccttctgcgaataatccacctccggcttatctgcaaaagtacggaatgcattagctgctgtctgaccagcttcacgaaatccttttgcaagaagtgctgtctttgctatatccgtatccgtggtctttattgcacctcttacattctctcggatatcaagaagccttttcttaattcctaagaactccgacactctgtataatgcagctcttccctttgcctttgcttcatcaactatgcactttgctgtagatttgacctgtgctttcacttccaatacctgcgactttatccgctcacatctgacattaagtcgctcctgtgcttccgacaatgcctttttagcattattcacaagggtatcttcctgcatttctttgatctggttctgcatgttggtgagttcttccgtcatggaatcaatctttttctccaatccatccacatagctgcatatctcaaatacatcgtttgcctgctctttcatggcatttttctttagtaattcgagaagttcccttataacctcctcattggtaagtgtttttcctgcttccatatccattctgtttcctccattctgtaaaaggggcagccttggccgcccctgtactctgattactgattatcgaaagggcgttgcctctttgtccttctctttatcgggattgccatgatgtttctctgcactctctcttgccttttcgttgctcttatcctttgctttctcatattccgagataatctcattatagagtttttccctgaaatcctttgtgaccggatagcagacatcctgatagattggcttgccctgctcatccacctgctttgtcttataagaaggcattgatacaaagattttctctttgccctgcacgatattgatgttatttacgatgaaactgttttcaaaataaatgcgtgcaagtcccttgatgttactgccttccctctcataaggtgtcacagttacggaaaactcaggcatttcaaaggaacctttggttccttgtgttctgtcctgcttctgtgtctcctctttctccggttccttgattcttgcataggcatcaaggatattggtatagagttcctcacgaaactctgctgtgataggattgcacacatccttatagatcacaccattgctttcatcacgctcattggagcggtatctaggcattgatacaaaaagctctcccttgtccttattctcaaggattgcaatattggtgatcttaaatgaatcaccgaataccactgttgcaaatcctttgatattgctgccctcttttgcccttacttcgtttaccttaattgaatacttcatatgctattcctcgctttctttttgttctttgttatgctccggtatgataagctcacaccaaaactgttctatctgttcacaagacaatctgccatttaaccagttgccaagtgtaacaaccattccgtcctgctcatagtagagccactcctgtgtttcaatgttcccctcatatacgatggtcacatcaaaatcaggcataaacaatccttcctcctcatcccatacacaggctatcccctgtctgagtgtcagattcaggctttcgacatacacagaccagccgcttacgactatctgaaagtcatcatcaatctctgcaatatcatcctcgatgtcgattagttcttccatttccgatattgcctcttctatatcaccaagtcggtatctcttattcatccatcaccgcctccttataaatgcacctgaccacaaaacgcatggttcctttctgggaacaggtaaaaagagttagttctttttcatctccctgtgtcttgatgctgttatcacatggatttactacctctgtctctgttacctcatagatatgcttcagtccatttttgtcggttatcatcacttcatcgtctatggatatctgacttagtggtgtaaaaaatgtgccatatctgctgccattgtgaccgcataacacacagttgccactctcaccgattcctgctgtttcttcgatatgaccaatcccggcattaagcactttacttgtggttccttccatcaccggatacctgatatctaagcccggtatctcaatgatgccgataacaccgccttctttaagaatggcttcatcctcttcactaatggaggtttgctcttcctccacatctttttcttcatcgtaatcaccctccaatgtctgctcaaattcacttatgagctgttctgtctgtttttctccggttgcccgccagaaaaaagggactgccataatggcaatccctgctgcaatcagtagtcctgcgaccacttttcttatgctcatattattcactctcctatcgtgttctgccctctctgtcggatggataagcacctttatcctctgctacaattgctgcagcttccatcctgtcatctgcttctctttcttcctccggtccgctcagatctgcatccacagcctttgcattttcaaggtctagctgggcattcagttcacactgtcttgccagcttctcattcagtttctcactgtacgcaaatggcttgtcatactcagactttgatgcttcaaggtcattctggtactgctcaatcttcttttctaggaaatcaatgttttcatggagtccattgaacaggttttccagcttcaccatactgccgacaggacttgtggaaagctctgccttgtactcagtctttccacgaagcaccatataattgatgccaaggaagttcttttccacaagcagctcaaatccgtggaatttaccgattgcagttgtctctccggtcttgcatttgctgattgcttcaagcatcatcgttccgccatccacacgctcagtgtaagttgctttgcctatagtaatggcaaattccggattatcaatcagctctttatcccttgcctttacatcctcacggacattggcaagcttttcagttgctgtcttaatcagctttgggtacttaatcataaagttatcctgcaagccatatctctggttgtcataggaagccttcaaaagctttaatctctggacatcattgtcaatctccatcttctcacgaataagaggattgcctgtggcgactgccttaatctctgcataggaaagtgttgcctcgtcgatgtcctcacagcttcggcttactgccttgcttgtcatgacctgactgatgaatcgctgcttattttcgatgagcgaccagttgtatgcatcaaaggttcctttggtgacatatctgtagattgcaacctcttcattttcgttgccctgtctgatgcctcgtccttccctctgttcaatggagcttggcttccaagggcagtccacatgatgcattgcaacaaggtgtgtctgcacatttacacctgttccacacttgtccgttgaaccgataagaactttctttttacctgtcctcatctccttaaaaagtgcgtctctttgtgcatccgtctttgcatcatggataaatgctatctcatctgccggaataccatactggataagagtttctttcagataatcatagatggtaaagtccttatccggtcccggtgtgccgatgtccgaaaaaataagctggcagcctatatgaccgttggcatttcctttctcatattctttccacacattttctgctaccttattgagctttccgtcaggattacttggtgcgtccttatcaatcagccttgcatctgttccgagtaatcttgcctcatgagtaatctttaggaagttgtccacgcttggatctactccacctcctctgatacgctctgccctcacaacaaaatcttccatgacctgctttacataccagtcaggctccgactccactataataggcttgccgccacgaagtgccggcacatcaaggtcaagcatgtctgcggtctgcacatctgctacctcacggaagatattcataagctccggcagattcgtaaacttattgaatctgcttttaaaacggaaaccgcttccctctacagtaagctccagtgctgttgtcacttcaccaaagttcgctgcccaggaatcaaagtgataaatccccatctcttcaagtgccgctttctgtaagtaaagctgcatgacatacatctcacacatggtattggatattggcgtacctgtcgcaaacacaatgcctctgccatcatttatctcagacaaatactggcatttaagctgcatatccgttgacttcttcgctccactgctgctgatacctgacacattattcatcttggaaaaaatcgcaaggttcttaaaattgtgcgcttcgtcaaccatgatagagtccacaccaagttcctcaaaggttataaggtcatccttcctactctcatctgataaggatttcagctgctcctccagctttttcttctggctttccatctgctttacagtccatctctctccgttacgctccttcatctcatcaatcgcatagctgatttcatcaatctgctcgttaagcattctttcctttctctcttcggagattgggattttctcaaactgcgagtgagacatgataatgcagtcatagtcacctgtcgcaatccttgatacgaactgtttcctgcggctcttctcaaaatcacgctctgtggcaaccaggatatttgctgacggataaagccttaaaaactctgatgccgtctgaccgataagtggctttggaacaaccatgatcgtcttattggcaagtccgagtctcttctgctccttgcaggcagccatcatctcaaaggactttccggcaccgacacagtgtgcaagcagtgtgtttcctccgagaaggattcttgccaccgcattcttctgatgtggctttaactcaatcgccggattcattcccggaaactgtaagtgacttccgtcatactcacgcagacggatgttattgaatgtctcgttgtaatactccacatatttctgtcttcgctccggctctgcaaacagccattccttgaacttctccttgatcatgttctgcttttcccttgcaagcattgtctcgttcttattgacttcgtaatgatatttgccatcaccgtcatcaatcctgtcccttactgttacagttttaagattcagcgtatcctcaaaaatagaataagcatccatgcggcttgtaccataagtcttagtagctgccactgaatgcttatccatgctcttattctcgatgaaccattccatgctcatcttatttaagtgtacctgaatgcctgtattgtaaaactggcttctgactgcccttgctcttcttggtgtattgagaagctcatagataaactgctcataatcaagcgactcaatccatgtcgtaccaatctttacatcaatatccgaggcttcaatccattccggctgcaccttttcaagtgctgccacatttcctgcaaatctttctgcctgcggattgtctgtatcagccgccatagcctttgctacacgaagtttgtctctcacatttcccgaaagatactcgtctgctgtctcccagccgatgtcgggattgttctcgttgtagcggtctggatttaggaaaaccagtccgtccagctcttccacaaggactgcccttctaagctctgctaatgcatcatcacttagcgttatctcatccactgtctgtccggacttttctgcaagttcttcctttgcatttgtaatatccggctcatagatagaaagcatataggcaagatttacatatccaaattcattgacggatacatttaatgcttccacagcggtctccactctgtctatgactgtctttgccttaatcgtctgcttataaaacatatccgcttttttcacctccccatcttcgtttacttcctcaagactgcaaagaagtggataatcgctgtcatccctgaatgctattctgtttgcttttgaagtaatggctccatactgctttacgaaggcatcatattttacattaagaagtctctgcttatcagaaagctcctcctcgctgcaaccatccatctggatatcaatcagctctcttgttatctgtctgatttcatcaaggcatcggattcgctcctcggcagtctgtgatacttctttttttaccatctcggaattttccctgtaatagagttttccttcaaaaaatgtgtaagtgtagtttctcacatccggatcagccgggataacttcctccgtctgctccgcctcatctgccactctctcaaaatctgtcatctgggctttgatattaccgatagccttattgagagtctcatacatattgaagttctcatcattattcacacagactgtatatctgctgtcctgtccgtaaatccttgtgtcatattccatagatccaagcatcatctccggatgctctgcaaaataagagttgactgcaatgccattctcagttacaccaaggtgtacccagtccggctcaatatcaatctttctctccctcttctgcaaaaacaggatatctgctgtcacttcggttcctgcattatctttaaatgcagtattcggaagtcttactgctcccacaagctctgctctttcagccagatactttcggatagtaggatttgccttatcaagtgttccctttgtggtgattactgcaaccatgcctcccggtcttacctgatcaagtgcttttgccagaaaataatcgtggatacggaagttatacttgttgtactttgaatcaaataccttataatcaccaaatggcacatttccgacaaccacatcaaagaagttatccggatatgtggtattctcaaatcctgtgatactgatattggcattctgataaagctgctttgcaattcttcctgaaatgctgtcaagctccaccccatacagcttgcttctctgcattggtgccggcatacttccaaagaagttaccgatacccatagatggctctaatacattgccgcctctgaaaccaaactggacaagtgccgaatttatgcacatggcaatctccggtgaagtataaaaggcgttatttactgttgcccttgcagcactgtattcctcatcagataaaaggtctttcagctctgcatattctttgctccagcctgcgttattctcatcaaatgcctgtgacagtccgccccatccgacaaacttcgacagagttttctgttcctcaggtgtggcaagcctgttctctgattcaatctgctttaaagtgcggattgcatccatattccactggtatctggtcttagcaccgcctttttccatttcccagaggttatagtggaaattgtgtttcgtctgcccgacaacattcttctcattttcaagactttctacttgctgtactggttcctgctttggtgtaaaatctacagtttcctgtgattctgtatcagcctgaatatcatccacagatactgataccacatcatctgaaactacatgtccattctcatcaatcttggtatcccagccattcgctattgctctttccctggtttcaagacgattggcttttacactatcctcgatatcaaagaatctcttatagaccggattcatcttatccctgtcagccttctgctttgtctcctgataatacttcttctggtcttctccgcagtaaaatggctgttttaccatataagataagatttcatataactcacgccaatcgagagcaccttctttacgcacaccattcctgttcttatagctgatcttcacatatccgcttctgattgagtactccacaagaccatacttattgttggaatatgcctttctttctgcattatctgtccctaatgcaatatccctgataaggtcaagtttattgggcataaatgcaaaatcagactgcaccacatccataaggaatgccctaaacggagtgtagcagctgcaatctgttacaagaatctccgccgcatcacgcaggtcttcatcaagctctgcaatacgcttggcataatcaatcggtgtaatatacttaagctctgatggatctttttcagatgtttcagcttctatctctgcaccatattctgcctgtgttaccatgcggtcttcatcggcagcttcctgtggtgtcatgccttttgcacttacataatctctgttagaagcatagctctccggctcatccggtattgcataatcatcaatctctgattctgcctcttccggttccacttcccgatattcggcatcaataacctcatcatcctcacggagtccgtccatcgcaagctcatcaatacgaggtgtctcaggctggtattcccctgtaagaataaggacaccaagctccttttcgatatctttccatgaaacatatccttcaacctctccatcctcatctcgccactgaaaacgcagtccgttcccatgaaatgtgtcatatccgtgcagtcccagtccgtcaaccggccagcctgcacctccctgaccatactctgctttgatacgctttgctctggttcctgcatcaatctctgtttcaaaaatcttgcataccctgcccttaccaccgataaaacctgtacctctcataagcacctgtttgatatactcacctggtactgtggctgacttctttggattcagataattgtatttacctgctaatgcagcttttctgtcctgctcgaactgacgcataaactgattattgttttcatcctcagtatgaatggtgccaatgcttgcctgcccgttctggtcgaaaaaaaaggaagcctgtgtatattcggcttccttactaacacccaatgaattgatttcatcaagttccctattcagttctgtatcatccgattctagtggaatcgcatcactatctgatggagtaccacttcctctgcctgcatcttcgcctgctctcttatcttccacatctccattgtcgatgacggatcctgtggcttgtgcttcgccagatactgcatctctaactggtcgtacagctgattcgcttcctcctctaccgctgacatcttctcgtacatcttcccgaatctcatcagcgtcttgtatcttgccggctcgttctcctttagatagttcatcgccatccttccgtatttgcccagcttcgtgagatcctccgtctcgtccggcatctctatctgcggataaagcagtccgtccacttccttgtaagtcatttcttctaacatatccaattctcctttcgctctcgattgcctttaagttacgactaaattctctaagaacactacaggagacatcgcatacaatggaaccaagacggtaaatgatctcttcgtctttgatatttacgatctgactaaaatcctgttcttgcacagataagtcaaatccgcatctcgtccctacagcatacatgacacttgcatatacaagctgctccatgtccatttcctgctgtaagccattgcgtttcttactttcttcctttatcacactacctgatagctgcataagctcggtcattcggtctccgaactcttcttttattataagccaaacatctgttcctgtaaactgttttaatatattttttagagactccctgtcgctgttatcgtactgctcaatctgaccttctgacacaagaaaatccacataatctttaagattttctccctcaaggtcccatgtcaacttaacattcttccctccggtatcactgatatcaaagatatacctcatgcgtggattcagtgcccttgacgggaagatggcgcagcctttcgcaccacgctttacatatcttcccacctttttccaggtatcataatctgccatgagtgtgcttttttccggaggtctctgagctgttaccataacgatattgtcaaattcatagcggtataactgacctgcgacctttaacacatccttccagttcttttctgatctggtgatgttaccaatttcagaatcgtatatcgctttgaccttcatatcaacgcccatacctttgtcctcctctacttaaacatctctgcaaacaatcccttaaatagctttaactcatccttatccagctcgattgcaaattcattgtcgattgcctgtttttcgcatttatcctttttctttgcaatcttacgcaccacacgaagaagcacatagcactccttggactttgcaatgctctgtttaaaggtcagctcatcctcatcgactgacttctgtgtctgatagataatctcttttaacttatcattgataccatctacttcctcaagggtaataataacggatgccttagaagcacccgatctgtcccactccttatgaagttcctttactaaaaactccatgttcttaattactgttgttgaatcacttttcatcttgctcttcctccgttttcttttaatgaagaagggagctgaccttcgctgataggtgtaaaatcaactcccttcatgtcctctgctccaaggactatctgctctacataatacatatccattgccttattgatggcatcgtcaagcgactctgcctttactttctgtactcgtgaaagcacttcctttatctcaacatcaaattcctgttccatatgatatcgcctcctgtaaaaatctcatcaccggcacttttcttcctttacctgtctttccttaaagccctcatcgtactttccatcttctagcctgtcgtaaaaacagtcctcttcaatcgttccgaaatcctcatacatctggtgaaggaaatcattctgcagtttctttggcacatcatcatcctttgacatatcctgataaaaatagaacttctgttttagctttgccctgtaatcatagatatcctctatcttttccggtgtgccatactccctctggtatgccttgaaatttgtagttgaaagtgtggaacctagataaatgccatgctcccacgataccccgattgtggtattgtcctttgtaggcttctcatccttcggataacgcttatactctgtcgcaccaagggcgattgtaagagaacctgacttcatatccatcaccacgagattccttggtgataatgcttcaagcaccatgtaatcatggtcattgaagttatgaaatgtctgtcctctctcaaaggttctgtcattcttctcataatgcaggataaaatcatctatccagcctttatccgtcattgcaagttctttcatctttgtcaggcactccggcgagcttaattccttatcaaatctaatttgctttgaatcattgtaaagtccctgcaggaaatgtcccagttgaacatcatccttacagaaccttgcaaatacagtaacatttggtgctctgtaatactctgtgaagttatctgcttcaccaagtgtccttccaagctgcaacaaattttctgcaagctctgacatgtcatcaattgctataaaactcttataatcatccagagccatcagcatatttgtctctgttcccctgtcgttttctgttaccagtatcatatcttttaaatccattcttacctccagtctcagagagggactatgccctctctgcaaatttcctgttatggtcttcctatcacaacaatctttcctgtgcttgccacatcccggtaaacaacaccaagactttcattaagcgcctctaccaccttgccatttccgacgtatactgccacatggctgatgttcttatatcttccgttgcttgtaaaactgtagaaaataaggtctcccggctgtaactcatcaaaggcgactgtctttccggcttcatccagtccctgtgcctccgctgccgctgtggttgcaccgccgtaactaatatccacgcctgcatctttccatgaataataggctaaggaactacagtcataatagttaccgctgtctcttaaatcctgactataaggaaagccaactctgtgaagtgcataggagcagactgttttctgcctgctgtctgtaatttcgtttaggatggcattgatttcatcctcagtcatggagcttactcccggacttccgcctccgccgccacttccgcttccggcatatccaagctgtcccataaactccggactcatgatctgctcaagcatttccacatgatcagagttaaacccatagaccgaaatcatatccctgtacgatttcagtgtgacattcacatacagaacagacttcgtgacagtagtcacattgccgtctgcatccgtttcttccacatcctttgttccggtgcttgtggtgtatgaacacatatcatttacaactgcctgcagccagcctttagaagtatcattcatgactgttgcagtatctccgacaccatgcttgaccatatagactgccatgatgtcatagtaattgcttgggttttcttccataccttcatagtccacatatacaagctctccaagatcatatccggtatgctcattcactttcgtgttcacatcccggttaaactcctgcacataagcactcgttactgtctgcacggtatctcctgattcaagtggtggcagaaataaagcaaatggtgaattgtaaaggattgctatcaccgctataaccggaaccgcaatcatggcaactacaagaacaagtaataaaagcaccaatccaacaatcggtgccgctgcctttacccaggtaatcgcttttcgcacaatcagatcctttaccagctttgccacgctgtctgtctgattctcctgtgctttcatcttatccagaaagaattttatcttcctgctccggttggtcattttttcatccttgacctctatggacacacctgcagcatatccggctgccatgccgattgccgtgccaactcccggtgcaaccgctgttcctgccgctgtagcagctgcctttgtggcagttttcgctgcaaccttggcagtagtcttggctgtttcttttgccgtctctttagctacagtcttggcagtatctttggcagctttctttgctgtcctttttgccagcttctttcctgcctctaccttcttgatacgcttctttgcctcgactgccgcctttttcctgaaaagtgctgcacccttggaagcagttccggtaacaggtcggcttgattcatatgcaagatatgctgcctgcgatacctcctgcccgccctccacctgctccgttactgccccagctgcaagtgctcctgttcttcctgcaatgtgaagattggtattcttggtcttgattgaagttcctgactctctgatgttacgcttaaacttagaaagacctttatccttagcctccgactgatgaatggtactctttctataagtactctttccaccagcacttttctgaagcattaattttgcagatgcttttttatccatttcattggctttagcatcatgcactttcggacctctctctactgtatagatgttgctgcctttaatcttggcaccctttggctcgtgggcatgaatcttggctttctccttggtgtgaatgaccataggtttgtcatcaaccttttttatcttcaatgttctcaccttctttctacatccattacccaaaaatgggtaaaaaaatagccatctggatgattagtccaaatggcttatgtaaaaatctatttaattctattgtaaagaactgtctctattctggttgataaatcaatctttttcttataaagaagtgtccacgatgcttgattttttgaataatccatcttttcctctggaaaaaatgaacgacagaaataattatctccttcatcattagataaaaacaaaaatagattcctgctctccacgttgttttccataagataatcagcctcaatcattgaatacatatttgctttcttattatacttaaacacagtatcattactatcaatcatttgttcaagcaatggcaggaaatgaactctttgctctatcttattataaaaatctgatgactctattttttcaattgtaattgttccatctgctatctcatcaaatactctgcctctgtctcggctcaattcaggtctgtctaccagatattgtaatcccataagatgaaaacaatcttttttatcaaatgaaattcttaatgtaactgaaacaccttttctccctagtacaagctcatattcggttgataatagcggaataaatgcatttatgcaatctaaaacattcctcattacagttctccactacatccttagattaagaaaggctctgcataagcagagcccttctaacattttctttcgaggattaacctctagccagattgtggtaaatgtcaaacccttataaagctcataaggcactgctctctggcacaacaccttactttgccgcttggcagacactcaagttgcctgtctttaatattatattacctgtcatatgaaaatatgtcaatccaaaattcatgacttcataaagaattaacatttttcatttgcatgctttttcatctcaattatctcgtgaatgttggtattgtacagcttatacaaatccgtatccttacttatctgattatcaaacggaatcaccacagaaccacacttgataagtcccattccagatgcagtattggttacaaatctaagctgtgcctctgatactccgataacctccgccatcttggaactgtctgtattcgcctgctttaaaagtgccacaaactcagagtttgcaagcattgtggttgctgtgtaattctgcaacagatcgactacattttgcgtgataccggtacaaagacctccctgttttctcactttcttccagagctgctgcagatattttgcagaatactcggaattaagtaagacatggaactcatcaatatagagccatgttgccttgcctctcttaccattctcaacaatcctgttctgaatggactccatcatgacaagcattgtgataggactaagctctgtacctaagtccctgatgccatatactgtgaatctgttatccacatccacatttgtctgatggttgaagatgttaagtgaaccatttacaaaaagctccaatgacaatgcaatgtcctttgcctcgtcctccggctgtgccataaggatatcgtaaaagtcactcattacagggatatacttctctttgctccttgcaatgtcgatatacagctttctcacacagcggtcaatgattgacttctgtcttgaatttaaactgtctccgatacactgctcacaaagtccaagcataaactcgcctttttctcttaccattccctttgaatcattcgggtcaaggctccacacatccatctccagcggattcacatagttatccgtgtaagtagacatatttactacagttccgccataagtctcagcaatatcaaagtattcgttcattggatctatgacgattatctcatcatcacccgacaagaatacgctgcccatctccatcttgcagaagaaggatttaccggaacccggcacaccaaatacaaagccatttccattaatgagcttctttctgttgccgatattcacattcttgctgatctggttgatgccataatagtttcctgtgctgtcatttaattcctgcacattaaatggcataagcaccgcaagtgactgggtaagaagtgtacgcattgtctccacctgtcttacaccaatcggaagtgctgtgttgagtgcttccctctgctttaagtagtgtgtatcaatcgtgcaactgttacgctttccgatagtctccacagtctcacatacactctcaagctccttcttgctttctgccataagaataatggttactcccacaaagaaaaggcactggtcattctcacggacatcatccatgatttcctcaatctcctttttctccgttctcttggcatatgagatttccgtagaaaaatcgttattcttattacggactctctgctgcttaatgatatccgactcaataccaaggtatttcttctgaagcacctttgtggtcagatcctttggtacgggcaccacatcaatgctcgtgatggaatgaaccggaagggaagtaatctcattgatgaatctgtctgacaaactgctcggatactttttgataaaaagtgccttgcagaatttactctcatcctcaaaatggtccgggaaatatttcaccattccattacatagatcatttctaaaatctggcccgaccttcttagcctttttgatatcaaaatcaaaactgccctcatctccaagatgataatagtcatagagcactttcagtctctcatttccattaagtggtacaatgtctgcaccaagctcaatgaaagccttgtgtatcgttgcctcaagggttgcaaactgtgcctttgcctcctcgaagttctttctctcaatcgtgattgtcaggtatctctcctgctcaatcccctgtctgccctcaataatcttctcctcaatgatgtcattgtagatacttctataattattgaagccatcgtttttctcagcaatcagaaccttgtcacggagttcatccatgtttttgttcttattgttgatcgtaatcttataattacagtccagcgaatttaagaacttgcagtatctctcaaatatgccgatctgctcatcctccgttgctgtcgtgtaattgatgtcctgaaagcggtagcatttggaatacttatttttgcttacttcaaaaatgccgttttcagccaccgccataatctctatggtttcctgaatggatttaggtgtcttatacaaaggctcactcgccttctttaataacttaaatccgtctgtaaataaacccatgtctctaacctcgctttcttataatgaaagcccgccgggaacttcaccctgcgggctgtgttcccgacctttcggtcagatactttttatctaatgcatcgccttatatgctgcaatgcctgctgctgccgccacaatgactgtgacaagtccaagcagcatgtttctcgtctttttcttcattgcttcaaactcctcctgcttctttacagctgaatcagctgttacagtctccggttcagcctttctgcctttcttctttacctgttcattctgttctgcttctaacttctttattgcaggctctccctctgttgatacataggtaagtgccctgttgccaaacataaaatgcagtttctttcccatatactcgtagaaattcatcccattaaaggaatagaatccgccaagagcaatcggtgccacacagggaattgccacataagcagaacccgtaagaccgatatacttataaagaagaaggacgataccgccaccgactactacgcttgcaatggaaaatataagctgccttgcagtaagtcccatcgcaaccgattcctgatagcggtcaatatccttgtttacttcgattaccattgtccctgcctcctatcttgataaatcctttgtctccggctttcttgtcattccaatattcgcctcatacttatccattccatccggacacagttctctaagcttatctacattgaacagataaagaggatattcacaataaccgctcctttgcgtgaatcctgtaaactctccaatgtcattgtctgtaataaacttttcaatatccggcatgtcattcacattcagatatccgcagtaatttggtgctgcaaccgacaaattcacagtcacatccccaaaaggttcctcatatccatcttcattacacataagaccaataaacattgccctgttattcatatactgctggatatcaaatgtcacctgcgtttctccggttatacttgaattataagtaacctgtttcttttcattatccatttctgcctccttctataatccaaatgccttgcttgtaagtgtctgtgcacccttcacgcttccaacagtcattgctatcgtaaatgtcatttcacacagatatataagcgtctgtgcccagtcagcataacttcctgtaaatgccggaagtcctgcgttgataaatgcattacataccacaatcgcaagtgccatcgttactgcctcaaatacacacgacaggaaatatttgcagtaggtagccattgtatgactgaccattctgtttcctgccatcgtggaacaggcaatcgcaccgagcggcacaataatcaggatctttaagaacctgaaatacactgtgtagatgatgaaaaatccacagataataatgatgattgcaagcaaggctgtaagtatcagcattaccagactttcaccaaatccgagtcccttaatgatgtctgcctgtgtactgtcaatagcaagctgcgtcgttgtcccggcagatataagtcccaccagatttcctatggaagtaaaaaatgctttcataatcgtgacattatttgcaacaaaccattctgcaagtcccagtcggataagcatacgcaggattgattcaaacctcatctcatcttttacatctatgctttccgagcagaaaccgataacaaagaacagcacaacgagggaagagccgaccgctacaaagaccggctctatcccctcaatgactgcccagggacctccgcccttgaaactgaccggtgactgtccaagcattgcaaagaccagggatatctgattgttccaaaacccaaacactgcctcaagaagtgcaaggatcttgtctccaagcttaaaaatatccatacttgttattcacctctttccttttactaaaaggggaaatgcatttccccaatcttagaagcctaagaatgtcagtactgttgaaataccagccatcatgacacctgctacaattcctttcagtgcagagttcatggtagatgaatcctgctgctggtaggcttgtgcgaactccataacattctttgcaagaatgatgacaccaaccgcaccaatgactgcaatgataagtgtctttaaattctcaagcggctgtgttactgcggaagtacctgtacctgctgcaaaacaggtagtgctcataagcatcactcccataagtgctccggataatgccggaacgaatctcttttttaagtgaatgaatctactcttcatgcctttctcctccatctgattgttgtttgttgttgaaataacctgttcttttctcatgttgtttaatctccttttttgaagtgacagaagcggaaaaagccagaaaggaatacacatattccaatccggctagctttccgaacggaatatatgcattcctttctgtcctgttgatagttactctatgataatcaggcaatgcctgttgtactggttaatcgggctttccccgatgcgtttttgctgtgaccatctcctttcaaggtatgaaaaaaagcaccttaaccatatggctaaagtgctaatttactctcaaatttgctttattctaaaagcattccatcaattattgcaaactttgtcttaaatatagatctattctggcaatatcgtaatatgacatcctgtacataaggtcttgtacaataactgtctaccacaatctgtttatcttcctctttctctatcctcttaaatatgccttttgcattccaatccgtctttacagcatctactaaatcattactcatctcaagatgtgataaaatcgtggaattcaactcggtttctttaatttcagatatttgtccatagtcattaagttgcttcaattctctcttaattgcctccgtgtaacttgtcatattattatctcctatcaataagtattcaggtgttacatctagtgcctttgctagttgtaaaagattatacgcacttggctcttcattgagtctaccttgttcataacgtcgtatactctgaacagatatatttgttatcttacccagctcttcctgtgtatagtttcgtatattacgcaactcttttaatctatctgcaaaagtcttttccgtattcatcctgtacctccaatataaaataatttctgtcttttgtaactgctcacatgttagtagtccaataagctgaagcataccatgtgagcaaattatatcatatactctgtaatatatctaaaaacattactgcttctttcgatatgaactcatcttctccacagtaacctccggataaaagtaagtaagaatcgttgccttcggaactcctgccgcaagtgccttcttcacttcctctttctgctccggtgtatatgaccagtgcagcattctgtttgtgatggtatcttcccacttaggcttttccctctcaggattccttacaggcttagcaccagtacttccattagatgcattggcactgtcagtagcatcagacttctgtgattcatcaacatactcaagctcatttgcctgttctctgtctatctttgctttctgctctgcttcatcctgcatggagaatcttctgcttaattccgcatcaccaagcatcataaactgctcataggtaagagagtctatatacacattctcgcccttgtccttcagtttttcataatacttaactgctttatctgaaaggatttcaaatggcggaccgataagattatctgctccccttatctgatgaacatatggttttcccttgccatctgccgtctggttaaacatcggatgattgaatggtataaacttattatccatgataggatcaaaaccacggataaagataatacactttttgttatccagctttctgacttcatcgggtgtaaacaattctttgccacaatgtcaagtgatgaattaaaaaaagctatcaaagaaatccttcttcgatagcagcgtattcaacatctattcacatttcctgccttgcgttcttcgagctaatgaaatataatgaaagaaattgtcggaggtatgagcatggactacatgacactcaaagaggcaagcgaaaaatggggcgtttcgtcccgtcaagtcaactattactgcgtcgaggggcgtattcccggcgctgtgaaaatggccggtgtttggctgcttcctaaagatgctgtaaagccggtcgatggcagaacaaaggaagggagagcacagaagtgagtcgaattttgcttttagaagacgatgaagcgctggggcgtggtatttgtatggcacttgaaacaccaaactgtaccgtcacacattgcagcacacgtctccaggcaatcaagattttgcagggcgtagtttttgatttattgattttggatattaacctgccagacggcagtgggctggaactgttgcgaacactgcgacagaatggcacctccacacctgctattttgcttacggctaatgatttggaactggatgaagttaccggtctggaagctggggcagatgattatattaccaagcctttctccttggcagtgctccgggccagagtaaatgcccaactgcggcgctctgtcccggtaaagcaggaacggatcgaattgaacggtttcatcctcgacttcacacggatggagttttccaaagaagggacaatcatcgacctttccaagacagaacagcgcctgttgcgcctgctggtggagaaccggggccgcacgttaccaagagaattgctgcttgaaaaggtgtgggacggcggcgagtttgtggatgaaaatgccttatctgtggcggtgcggcgcctgcgcgggaagctcgggaatgccccgatcagaactgtgtacggggttggttacacttgggaggtaagcaaatgacagctttgacctgggtgttgctggctttcgctgtcattgggcttctatttgggctctggcagtggacggcccggcgcagaaccgttcagcggctggataatatgttggaacagtctatttccagtggttttaccgaggaacattttgatgaaacagaactgtctgcgctggagacaaaatttgctcgcttcctgcgcggctctgctcatacgcaaaaaacgatgaaaaccgaacaggaagcggtgaaaacactgatctccgatatttcccatcagacgcgcacacccatcgcaaatttacttgtatacgcttcgcttttgacggaaagcgatctgtcgccgcgtcagcgggaacaagtccaggcgctgctaacacagggggagaaactgtcatttctgattcagactctggttaaggcttcgagattggaaacaggtattgtggttccaactcccacactgggtcctgtggctcctttattagaggcgactgtcgaacaggaaagacctgcggcggaaaaaaagaaaatcaccttgcagaaccttccgtttgtaggcgacgcctcctttgacccgcgctggacaagcgaagcccttggcaatgttgtaaacaacgcggtaaagtacacacccgctggcggaagggttaccgtatctgcacagatgctcgaaaccttttgccgggtggacgtgacggatacgggccccggtattccagaagaagaacagggcgggatttttaaccgcttctatcgtggtacgttaacgcactcggcggaggggcttggcctgggactttacctggcacgggaaattctgtcccttcagggcggttatatcaaagtatcctccaaaccaggaaacggaagcactttctcactgtatttgcctcgtgcgttgaatcggatatgaagaacaggaaatctttcaactctgttagatttgagaaaggctcaggaaagaattatgtggtaaagtctgtattgtcaaaaggcaatgcagacttttttgtggaggtatacaagatgacgattttagaaaccaaaaacttaaagaaatattacggaaaaggagatacgcaggtaaaagcactggatggtgtcaatctcagcgtggaggacggggagttcgtagccatcgtgggcaccagcggctccggcaagtccaccctgctccacatgctggggggcctggaccggcccacttccggctccgtcaccgtggacgggaagaacatcttctccctgaaggatgaggcactcacaatttttcgccgccgaaaaattggttttgtatttcaaagttttaacctggtgccggtgctgacggtgcgggaaaacatcgttttgcccatccagttggatggtggtaaagtagatgagcgctatgtaggtgaggtagtcaccgccttggggctggaaaagaagttgaacagcctgccggggcagctttccggcggccagcagcagcgggtggctatcgcccgtgccttggcgaccaaaccggccattctcctggccgacgaaccgaccggaaacttggacagccgtaccagccaagatgtactgagcctgatgaaggtgacgggccggaaattttcccaaacgatggtcatgattacacacaacgaagaaattgcccaactctctgaccgaattgtccgcattgaggatgggcggattgtgacacagtaaggggggagagccatgaaagtttcaaatcgaaaatgtgttcgccatttggcgtggaaaagcctgctggcaagccgcacgcgcaatctgattgccattgtggctatcgccctgacaacgatgctgtttacttctctattcaccatcgccttgtccatcaacgatgggtttcagcaatccaattttcgacaggtgggcggcttctcccacggcggatttaagtacatgacccaggcgcagtttgatgaactgaaggatgatcctctcatcggccagtggggcgaacggagatacctgggtatgcctagggaggcgcctttcaataaagctcatgtggaggtgagctttgccgacgccaacgaggcccactggatgtactgtgacccggtggaaggctctttgccgcaggagggcaccgaccaggctgctaccgacacccatgtactggaactgctgggcataaagccggagatcggggccgagtttaccctcacttttgacgtagatggacacgaaaccactcaaaccttcaccctctgtggctggtgggaatacgatgaggccattgtggcgaaccatgtcctgattcccgaaagccgggtgaacgaaatcctggcggaagtgggcgtagatcctgacagccctgatgacggcatgacaggccggtggaatttggacgtgatgctgaaaagcgactcccgacatatcgagcgggatttgaaccaaattttggaaaaccacggctaccagagcgagaccgctggggacaattacattgataccggcgtcaactggggctacaccggggcccggatgtccgacattgtggaccccatgacggtcatggccattgccggggtaatcctgcttatcgttttcaccgggtatctcatcatctacaatgtgttccagatctcggtggccggggatatccggttctatggccttctgaaaaccatcggcaccaccccccggcaactgcggcggatcatccgtctgcaagccctgaccctctctgctgttggtatccccatcgggctggtgatcggctggctgatcggcgggcagctaaccccggtgattgtggcccggctcaacgggattatgccaatgacctctgtaagcccctggatctttgtcgtttccgcggccttcgcactgctgacggtgctgatctcctgccggaagccgggacggatggcggccagggtctccccggtggaggcagtgcgctacaccgaaggcagcagcgaaaagacccgtgttaagggccggaaggcccgaaaggtcagtcccttcacgatggcctgggccaacctgggccgcagcaagggaaagaccgtggtgacggtgctgtcgctgtcactggcggtggtgctgcttactgtgacggtgaactttgccggtggctttgatatggacaagtatgtgtccaatttcaccgccagcgatttcattgtggccaatgctggaaaattccagaccagcaccctgttcagtgcggaacaggccgtgccccagtccgtcattgatgacatcgacgcccagggcggcatcaccgacagcggcgtggtgtacggccagacctctcctgtgctggagtacgtcaccgaagactggttccggcagaacaagcagaacttctacaccccggaggagatggacaacctgatacgcctgactgataagaacgaggcgggcctgctggccgacggggttcagatctccggtatgagcgattttgccctggaccacctgacggtgctggagggagatttgtccgccctctacgagccgggcagccgggctatcgccgccgtatactcagaggacgattatggaaacgcagacatggcctcccactgggctcggttgggggacaccgtcaccctccgctatgtggaggagagcgagtattacgacccagacaccggcgaggtctgggcttccctggaggatgtgccggacggggccaactgggtggagcggccggtgaagtaccgggacgttgactacaccgtggcggccctggtgacggtgccctccgccctcagctaccgctactatggtagcgatgagttcatcctgaacgacgagacctttgtccaggacaccggcacgtcggatgtgatgtactacgccttcgacaccaccgacgagaccaacgccgccatggagtccttcctggcggattacactgagaacgtcaacccggagctggactacgagagcaaggccacctatgctggggaatttgagagtatgcgctccatgttcctgctgctgggcggtgcgctcagtttcatcgttgggttggtcggtgtgctgaacttcttcaatgccatcctgactggcatcattgcacgtcagagggagctggcggtgctccaggccgtgggcatgaccggacggcaactgcgcgctatgctgatctgggaaggattgctgtacgctctgggggcggcagggctggctctgattttgacgctgacgttgggcccgattgccttccaggcggtggaaggactattctggttttttacctaccatctgaacctcacgcccttcctgttcatcatccctctctttgccttgcttggggctggtattcctgttatcaccggccatgagatggcaaaacgcaccgtagtggaacggttgcggatggagtaaacccaatcaatataatgctgccggacgacggcaaaataaaagccccatccctcaatggttgtgagagatggggcaaactatttacgctgcaatctccgggatttccccgacaaagttatacacgatcttgacttcctgcaccttctggccgtccacctttttgacctcgccaatcaggattttgctgataagccggttcagtaccgcctcgtccagttcctcaatggcggcatagcgccggatttccttgataaaggtgcggacttcgctttcctgtgcgtccgcccggctctgcatcaatgccagatcgtgcaggcgtttctggttggcttcctgttcctgttccagcgccgccgtcagcttcataaaccgctgttcagtcaggacgcctttggccttatcggtgtacaggcttaaaaacatcccgtcaatttcctgattccgggcttccagccgtttccgttccttctctgtctgggaagcgtccaccagataccggcgctccatccggctgctgagccgctggtaaaacgcatcggcgtccttcatggcctgcgccgccagttcctgtatatccttcagcaccagattgtacaaatccctggcctcgatcttgtggctggagcagaccttgcagcccatgcggttgtaggtctgacagatataatacgccttgtcgatcggctcccgcatctcgccggtgaagcggttcttcccggttctcccgaccttctcataccgcacctgcatggacttcccgcaggtggcgcagtagaccagcccgtggaacagattataaaaggggcaggaatttccctgaatggtcggtctgcggtcaatcagttcctgcacctgttgccattcctccggcgtcacaatggcctcgtggcagccctcgatcacttcccactggtcacgggggataatatcataggtgttggagcggatgcccttctggtgcgtccgaaagaccagatgtgcgcctttatagaagggattccgcaggatatggctgattctcgcccctccccaggaataatagttggcgtcaaactccgtgttggccttgacacgggtgatggggattttttcttccatcagccgtttggaaatcctcatgcagcccagcccgtcaagggcatagtcatagattttgcggatgatcggcgctgtctccgggtcaaggataagatgccctttgtcctccgggtcacgcatcagaccaaacggcggcgtcccgccgcagaactttccctgccgggagcgggtagtgatgcccgccagcaccttcttggaaatatcccggctgtacatatcgttcaggatattcttaaagggtgtgatgtccatctcctgacgggtcaggctgtccacgccgtccgtgacggcgatatagcgtacattgtgtttggggaaaaagatttcgatatagctgccggcttcgatataattcctaccaagcctcgataggtctttcgtgaccacgcagccgacctttcccgcctcaatgtcagcgatcatgcgctggaacgagggacggttgaaattgcggcccgtgtagccgtcatccacataatactcatactggaacatcccatgcttttctgcgaagtcccgaagcataagtttctggttgctgatgctcatactctcattgtcgccgccgtcatccagagagatgcggcagtagagagcggtgattttctcatagacttgttttttcctgctcatagcgttctccttctatgaacagggacacgataccattatagtaccatgtccctgtccctgaatcaaccgtttttacgcagctttttctgccatttcccgctgatgacgccattcctcgaagtgttcgcaggtctggcgctcaatgagctgctcaaaggcttcccgcatggacttctccccggagaactcccgcaccaccacaaaacggactttattcttctgatttttgcttttttccataggctacctccatagagagacaggcctgacggcagcatcggcaacgaagtccggcaacgaacctctgaaaacctgtaaactaccgtctggcctgtaaatcttactttgtgaattttcttgaaaaatctcgttgctttcgttgccggagataaagataaatagtaaaatatcccttagttattggcttttcctgtatccagacagggaaatccccggcaacgaacccggcaaccaactggcaaccatcccggcaacggaccgccattttcaggcgatccactccttcggaagctccaactggcggcattcttcctcggatagttccacaaattcatcttcgttgccgggcagttcgttgccggaaacatcccgttcccagcccttctgcctgccgtatccggcgaacattctcggattcgagaacggcttccagcccgtcaccaccgtattcatgatctcgttgatattgtgaagctgccaccgcttcggctcgtcataagtgtggcccagcgcctccttgaaaagctgtttggagcagaccatgctgccggtgtagtgttccagaaatccctgtatctgcccggcctcggtgtcctccggcatgaaatccttctgcacctccacaagctggcgctggatggacttgctgaacttcatggaatagtggccgcttcggtaaaccgtcatggcctccgcccagacctgcaacagataggctctggaagcgtcctcgtcctccaaaatgtgaacctccgcattctccgggtaaatcatgatgggaaggaagcgccggttcccggcccggtcaaggggcaggaagtccagcgtgttggaagaaccgccgaacacgcactgccgcagccggtctttgggctgggcctcatagggtgtgcggtaggtttccttctggcggctgataaacgagcggatttcctcaatgcttttggcgctgctggtggccagcatttccgacatctcgatgatccagtggccttgcagcttcaaatacaccctgtcatcatccagctttttcagatcgtcactgaaccactcgtcccggatcgccagcaggcggaagaagctggacttaccagccccctggccgcccaccagacagagcatttcctcgtatttggagccggggaaaaacacccgccggatagcgcccagcagaaagtgttttaacatttcctccacatagtcgctgacctccgcacctaagaagtgatggagacaggagcggatgcggggcgtcccgtcccatacaaggccgttcagcacgtcctgtatgggatggtagcagttctcattcgccacgatggaaagcgccgccgtcattttcttctcgctggtcaggccgtagttctgctcaaaatagagaagcagatacttcacatccgtatctgtcagggcgctggtgttcctgcgccagcccaaatcccgcacgatgtccacccggtcagtcaggaggttcaggcggatcgccccacgcaggagagggtcatggcagaacaccgtccggcagttgccgatggtgttggcgggctggcctttctccgtgacggacaggctttcccgcacctcgtcaacgctctgctccggcgctaaggcttcggctgcgctcatagcggcctgccgggtggctggcggtaaactctgatattcgctgctcaatcttcctcacctcttttccatactcagcgaccacgcaggcccgttcctccatactgccggacaaaagaatatccagcagatattcggtgtatggtttcttttgcagggcctccacaaacagcgggttccatgcttcctccggcgtatacggggcatattccttctcccagcgttccagcagatgcagataatcgcacagtacccggaagcatttctgctccgcctgccggtagcgcagttcctcgctgattttccgtctgaccggcctcctgcggggcgggtcatggcctttggcgtcaaagctgaccgagaaatcctccgccagcttcaaggccgcctcttttttgttcagcccgaacagacgggcggcaaaatcaatcacatccccgtccgcctgacagccgaaacagtggaaccggcggtcaaccttcatgctgggatgtttgtcatcatggaagggacagcaggccatcccgttcctgccgacccgtaccccgtaagattccgcagcctgccttgtggggacagcctgcttcaccgcttcaaatacattcgattttctcacctccagacagagaaaaaggcacccggtttccgcaggaaatcagatgccttacaactccatatcctgtttctttgtgggggcgatccgcccctcccgttcccaacgctcccggttatcccggtcagcgtcaatttttgcctttgccagcatatccataatggattctttggctttcttcttgacctgctccttcccggcctgcttgacttccggctgcatcagcgtccgctggatttttgccagagcagtctgcatgacatttttaatcttgttaatgaccccatccagacgggcagcggcgtactcacgctccttctttggagccttgcgctccggcgaaagcacccattttttcgattcctccaccagacgaatatcttccttgtgcgtctcctgccggacggtatcggtcacgacctccaccgccttgtcataggccgcatcggaaacatcatccaacagcgtctccacgtcctcgattttgagcgtcagttcttccagcttctgctcctgcgccgcaagctgctccttctgcttcatcaggatataatcctgtttttccagatagtcccgcccgccgtaggacggctcctgatccagatgcagcccatgccgtctggcgatgtcaaacaggatcgtccggcagaccgcatcaaaggtctgcttgcggttgttgttccggcctttgggcttctccgggttggggagagggatgcccagttcttccagcgccttttcctgctgggggcacagctccccgtagcggttctcacagtcaaagacgtgccgctcatggatgtggggcgtcccctcgtccagatggagcgcccagtctaagatgtggatatgggaaccgaagcggcgctcaaattcctcataaaactcattgacgatggaaaagagcgtatccggcgggacggattctcccatcgtgccaatctggtagatgctttcctccgggcaggtcttgttatttttcagcaagtcctccacggtgcggttgcgctccgtgtgccgggttttctcattccgggcgttctgggcctccacatggccgccgtaatgctcgtagtagtacatccgctcgatttcctcaaagctgaaatccggctgctccgggttttcccggaactcgtgtgtcgtaaagccccggtagcagtcccagtagacattctgccttgcccgttctgcgtcaatgtgttcgctgttctccacatcgaaccggcggtcattgtggcggggattataggtgccatgcttgccggagcgtccattgtgtcgtgtcagtttcaaacagatttcctccttcctgcgaagatgctgcggggccgggaaggggcggcgaagccgcaaatcctgcgaattttgcgtcaggtaatacccagtacgacttgacgcaggcatcaactctccctgggcaaggcgtttcacccttgacccgatggggcggctgccctcaacccgccaaggcacttcgtccttgacccgataatggctgccgcccttaacccgccaatgggcgttgccccttgcccccagcagtgcgctgccgcccctgcaccccggcacaaagggctggctgccctctgtactcccgcaagcgaagctggcttccaccgcaagagcggtgtttgccagtttcaccggctccgtatccgcacatttgcgcccataggcggggagtggatacggaatacgcctgcggggattgccagtcaaaacagcgggtgcagacccgtcattttttccgtaaacgccccgatttcaggcgattttttcttccgctcccaccacctgaaagccatgctcctttgcgtaggcgctggcagcggctttccgttcctcgctgtacggcggcaccagccggatcgacagccgggacttatccagcacataggttacactgccctccggcgtgctgcgctccaaccggcacagcagagggtacttccggctgaaatcagccagcctgcgcttcaagctggcgttaaaggtgtagacgctggcaaggttctccgcctcgttccagttgatgatggtttctttctcatacttagacagcttcctcatacagatcctcctcatactcggtgtaagatttcagcacacgcaggctgcgcttgagacggcggtactcgtccatctccatccgcagatggtggtaaaaatcctcgtaccagctttcatctacctctgtctccaccttccgggccagccccagcatccggcgtttggcctccgggtcaaccgtcagggccgtcagccatttcagccgtgtcaccgtattgtggtggctgggacagccgtaagcgtagagaatcttcttttctttcatactcagtgtcataatgatttcctccatttctttgctgcggggccatgcgccccgcatgataaacttgtttcctgtccgccggtctgcctgcaagccgctcctgcccggaatttctcccggcgtatcggcctctttagtgcgctcgatttctgtcctggcgtcacttccccgaaggccataccccttgcagccggtcattcgattttcaaggttctgtgcctgtctgcaagaaccagtctaccgaaaaaataggccctttcccgtatatccaaaacgtcggaaaaacgcccgaaatccgcatatttccacgcttatggaatcgtgctataatgggtgtaatcactgaaaaacgataacgagagagggggctttggatgtacgcaaagctgacaatcccggagcggctcaaagacctgcgggtggtggacaagcacctgacgctggaacaactggcggagcagaccggcctgtctaaatccgcgctgggaaaatacgaaaccgatgactacaaggacatcagcccgtttgcgattgcaacgctggcggacttttacggcgtgtccaccgactatctgatggggctgacggaaaataaaaatcacccaaacacagaacttcaatctctgcatctgagtgatgatatggtggaacttttgagcagcggcaaaatcaacaaccggcttctctgcgaactggctacccacccgaatttccggcggctgatgatagatatggaaatctgcatcgaccagattgccaatatgcgggtggagcagatgaatctggtgttggaggccacccggcagaccgtcatgagcaaatatgctcccggagaagatgacctctatatgcggacgctggaactggggcaggtgcaggaaagcgatttttacagccacgtcatacacgatgatctggacagcatcgtccgggacatccgggaagcacaccgcaaggacaagactaccgccgacccgcagcccgcgctggatgatgtaaaggaaaaatttgaacaggcgctcaagcagggcagccaggaggaaatgaccatccacggattttgcgatgcaatgcaaattccctttgagaagatttcctcggaggatttttcggcatttttgcggatactgagcctgtccaaacttctcaaaaatcccaacaacatgcgaggaaaggccagccccatcctgcccaaccgtaaggctaggcgcaagcagaagtaagtctgccggtatcggctttatgtatatccctgtctgtattttccagtttaagggaagaaacgccggttccagagtcccttgcagacgcagttcggtatgtcttgtagacatagcccatcactcgatattcgcttctgacaataaaaagtataagtctggacacggcagaatcagagtgacttgcggtacagctaccgggcgtgtttgtcacggttgacggctgtaaaggcagaaaaaaggccatccgccgattgatcggcaaatgacctttatgaaactgtattctgttgtggtggttgtgcccaaaatgggcacagccaaaagtcgatgttgtttcgattttagtcggagtcaaaatgaccccgactactttcgcgcgttaaagtaggtgtccccaatttgggtacacctacttcaaaagaataacggaaataattcctgcaattttggtagttctcaaaatgggaaccaccactttatccagataaagcgagtgactgatttctggtgggtatcattttgatacccaccacttcacaatgctaaagtggtagtggccactttgtccaccaccacttcatgagattaaagtagccgtactcaaaatgagaacggctacaatgggggatattactctttttccctttgcgacacctgctcatgggcttcctgctggacaagcagtcccgccgaaaagccatatttgaagtggctttcgttttcctcacactgagcgattgccacctgcgcccgcagttcttcaaccagtgtatagtcctctttgctcagatgctccgataaggtgtccatcagggcggcactggccttgactgcctgcttgaacctcggtgaatcagcgactaccgtttcacagggataaaatctgccgttaaacatttcttccagtatcatgcacccacctccctcagacaaaaatcatctcagacaggatgatttcctctgcccggctgcggatgctgttcatggcctcgacccatgcaagctggtcacgggctttcagttcctcggtgacggcctccgccttctgcatctgcgagacgatacacgccagccggtcagcggcctgttcgttcaggtcagcaagatacgtccagagctttcccgacagaagcagggcattatactggccgggacggtgttcttgtagaaacgccttgtgcatccggccccaccgtccaatggggcggctttcctccggtagcttcagatcggggatgtagtagtctcccaccagcgtgtagctgatgccgttttgatggattttctttggtaaatgctccatgttcgacctcctgtattcagtttttttcagaatccagttgatcgtgtccctgttcatgataaattcaaggcaactgaactcttcacgaacaagtatggcatatctcttcctaacacatcataattccttgatgagcttccctgtctgccctttgtctctccacttgacttcttatcaatcgtaccttttccaagcaactcagacacatacttatgtgtactctgctcatttccaccaagatatatgaaagtatcgcagttgccgggaattgtctcccaggtatctttaaaaagtgcttttaactgggcaaagttctgaataatgataatacttgaaatctcacggcttcgcattgtcgataacagtgaacagaagtcatctggcaatgcgacattcgcaaattcatctaacataaatgtcacatggattggcagccttccaccacaattaaagtctgcctgatagtataattcctgaaatatctgcgtgtataacataccgataataaagttataggatttatcactatccgggattacacaaaacagtgctgtctttgtctcaccatccccatttactccaataccgatatcggacagattaagctcatcttttgagagtagtcgtaaaacctgcttattctcaagaaatgcaagtcttgagttgacacttatgataatggaacggactgtatctcctgcacctctcatacatttgttgtactgcttgactgccggatgattggctccgagtggggaactttcctctaaaaacttcatacgcacatccagctttgatgccttcccctgctctgtaacctctgcttctccaagaagtttaagtactgtctcaaagtttctctttgccggctgtacctccagccacacataataaaagatagcctgtaagaacaatccttccgccttttcccagaacggatcacttggtgtcgctccctttggtgtcgtattgctgataaggtttgtaatcagcttgaccacatctgtttcctctctgatataggaaaatggattgtaacagtctgatttatccatctctaacagattaatgactttcaggttatatccgttattttttaacatctgcccacagcttctaaggatttctccctttggatcggtacagataaaggaacagttatgcggcatctgcataagattcggctttacttcataaaatgtctttcctgctccggaaccaccacagataaggatatttccattgagcttgagcctcctgaaatccagcgacatcttcacattctggctgagtatccggttgaaattttcatccttatctgcaagtatcttgttgacctgcttcggattttcaaatcttgctgtaccaaattccttacccggcatatagtttctctgactggtgtaatacatgacaatagccatcgcatagatacctaatgcaatggctactgcttttactgtattggaattgtaatagttggcaaagggaacagcacatacttcattgaatctgtccataaattcattaaaggcaatcccttccgtccacgcaccatttatcagataaccaagataccctgctaacactgcacccacaagaatgaatatcagtgacggctttttctttgttgtctgcataggctgctacctcgctttctttgtggtaacagttttcttctgtgtggtctttttctgctgcttctgcactttctcgtaacgctccctgacagatgactccaccttgtcgtagtgagtataaagctcggttcctttctgggttgtcaccacacgattctgctcatcgtaaagcttgtaattcttggttgaatcaaggaaggtaagcattgtctttccaccatgaatctccatgatgttttccttacggagccatacatatcttacatcttctccccatgtgccgggaactctggtcttaacagcatggtcattttcttcaataatcagcttcttgctgatagtcacatctgacaggttcgcattctttgatgctgcaactgccctcattctctcagcaaggtcctgatagcctctgacacggttgataaatgcatccttgtccatcatgactgtatgggtgccatcctcatttttctttccaagcacaccgattgtctctagctgtttgataacactttcagcctgctcaccattgatactgaaattctccttgacctgatccacactgatagctttcttttccattgcaaacattccgactttttcaatcagtccgtcaatggcggaatttaccttatccccttctatcgtgtggcttttctcgtttccctgctgtttcttcaaaaaatccatcagcttgccaagggacttttcatctccattcttcagataatcatcaaatgtggcaatcttaccaaacttgagcttctgtatcatcatattcacacgtggaactgcctctgtatgaaagattacctcactcaatccgtctttcctgttacagtcaggaagtactgaatagagtattccatacttctttgccatcttttcaacctttttcatatcttcggtattaaactgtaacacctgtaaatcgccaccttttaagatcagctttctcatggatgtcttgccaagtgacttttcataatcaagcatcccttttaagaaatctattgccttctgcatggcagctattccaccacttcctaccttcatggcaatctcaatgccatcataagcaacacggatgatctgcaccgcttcctgaatttcctctgccattatcgcacctccactttttctctgactgttgttttaagtgtttctgtctctgtagtacggatttcctcggctgatacatcaataccataagcagtcaaaatatctgccagatgattgattgctttctcctcctcgatacggtacatttcaagtgccacaagcaggttttccacctgttccacccatgcaggcttcatatcatatttagctctgtatgtgaccataatatcgtccgactcagccttatccgccgaatgtcccaaagcttcaataagacaaatcgtatcttccttgctgccgcttctgaatgcgaactgaacaacaaagtttttctcttcctctgtaaactgatgctccacaccattcatctctgttactgcttcatttactactgctaaattcataagttcctcctaatctgccatgctgttttcaagcacagcaatctcaatgatctccttcatcttttccgctgaaatgttgttgtttataagttctacaagctgtgactcagtaagtcccttttctattgcactcttaatctgcacaagctgcgccggaacaaggtctcctgttgctacaagtctgacgatgtctgctcttgaccttttcttaaaggaaagtcttgcaaaaaggctcgccactccgctgttgctgctctttctcacacttcgctcaatcggaagtctctgcaccacatttccagagccatcaactaccggaatctgataatagaccggaatcccatttgccacagcctgcatattctgcggaactgcaactgtatcaaccatctttttttctgcctgtagtacggactggctttcctgcggctctgccttactttctgcctctttcttattctctgtggcaacacttatgatcttatcttccaatgactctattctgtctcccatacgcttcatctccttatcctttttctcaatatcatccctgagtcttgcaatcgtactgcttgccttattcagttcattctgctgactgttgataagagcatccttatcctgattctccttgaccagacgctccctgacttcctcatcatctttggaagtttctatttcagaaagcttcttattcagggcatcatacctttcattctggtgattgatctttgcaaccacttcatccatctgagctacaagacttttcacatactctaaatcctgtggcatctgctctttggctttattaagcttttctaataccacatcaaacatcctgcgcatatttactgctgtatcatctttttggactacctctctgattgcatcaatcggcacacctttttcatagtaatccaatgctgtctgcatcttaggtgctgccatcctgctatctttcagcagcgttaacaactcttctgatacacccttatgcagacattttgataacaccttcatctgctcaatgtcataacttttgttaagatacagaccgatttcatcatcagtcagtccatattcataatcgcttttgacaagagcaataacctcactgtccatatgcttattacgaagaatctgtatctttctctcaatcgccatttcacttaatggctctcttttttcttccatatatgcctcctaaccactaaaaaaacagcctaacgtaccggctgttcttttctgtctcttattgtttctttgtcatactgcttctcttctgccgaagctgataccgtaagttccttccatattgatcttccaagattaagttcctttgataccgcccgttctgccttacagtcctgtgcatacttgctctcatatttttttctaagactctcgacctcttccacactgtatccctgtgccagaagctcagtgttaagcctttcccatgcattgtgctcatcttcaaaaaaggtatccccactctgataacacgattccgcatcatcaagcccccggatctgttcagccttgtcaaaaatatctttgaatctttccttagccttataggtcttactcttttcctttgatgcttcttttttcttatccgtcagattatcaagtaccgatacaagttcttccgcactctcaatcttatgccttaccagaaatagatactgctcctgcagcttatgcatctttcggatatcatccttatacttccacacctgactatatggcttctttttcagctttctaatccggtaaagctttgcataatatcttttctgcaagcctgacatcttcgccctgcggtatcttttgacatagcactttactatcgctgcctgcctttcctcattctgtgactggtaaaaggataaatcttccttcgcaatacgctccacaatagcttcctgtgaataattctcgccaagagtcttacatcttctgaatcttgtcatcccctgtggtctgactgccagatactttccctgcttgacctcatatcctttttccgacagcagctccagaaatccactaaaatcatttgcctgtaaaatgcaggcatcaaaatctctttttatcatatctgcccacacaaagctgccttcacgatattcgctccaatccttataattctcgtgctgtttctctttgctgccatcctccacatctataatggaaagaccatactcctgacacagcttattggtaatcggctggatatactttgcccagtcacctttctcgtagcgatactttttcccatccacaaagcttacactgttaaatacaatgtgtgaatgaacatggtctgtattatcatgaaccacaaataccgcttcataggcatcaccaagatattctgctacaaacttctgtgttatctcaaaagccctgtccggttccacctcatcctctttgaaagaaagaatgatgtgatacccctgtcgcttgtctgtttttccaaactgcttctttgtatccatcatctgttcaaaagccatatctgcctggcagtttatagctcccacaagtcttcctccctgcgttttctcaggattcatcacataatccagtgcccgtttcaaatgccttgcatgaaaagaattcccgctgtccttcatatgaagtatcttactgattgccaatctttaccaccgcctcgctgacagaccgattcagctttttcatatatgccacaagctgttccttatctttcttggaatacagctgtgcattgctgttaaatacaatctgattgatgttaatgccgattcggtttatctcattgataagctctttaagaagtttccttacttccggataatcatttggtttctgactgattagaagcctgatatattcggcttcattcattccatttgcctttgccttatcagaaagtaccttcgcttcctgtggcataagtcttagtgttttccttatacaatgaactttatcagccatagaatcaccttcccctcttacccgtactgtattctcttactccttctgctactgttacagcagctttttccagttctttattacccagctgggcaataaccctgtctgcaagctctgtagcaacttctataagttccttaccataacaggttttatcaaacaatctgtccagtctcttttcatctgctttcagactttcatacttgctctgatactcgttatagtcgttaaaatcctttggatcactcctgtgtgcttccgcatcaagtatcagttcatagttccattcacagacaatatctataacatcatctatcgggtatggttcaatttcaccattctcctcagctacatcctgcctgtacatcttcccatctgaatctatgccaatggcataatcatgtccttccatatagttaagcagaattgcagcatcttctatcgaagggtttagtaagatatcaaatgtgtctgcccaggcaataagttcctctggttctgcgattattgtaagttctttatccattgctttcctgcacctcccttatccgtgttttgtatatctcttccacccacacgcctgtctgaatctcttaggtttacggctagatacgcattagagacatctctgtcctaatgccatctagttagggagaaaatctccctaaaaccctctgtttatgaaagtgggggcgctttttgcccccactttgctactttgggggcgctttctgcccccattttgttattgtgggggcgctttctgcccccacttttatttttacttcagtccggattttgtcgtgtccaaattgtgggggcactttttgcccccactttgacattttgggggcgctttctgcccccactttgctattttgggggcgctttctgcccccacacatcaaaatccggtttctcatgccctgactggttcatctgctcgcttattcatcctgttcagattaagctttgtcgctacaagccactcgttgtaatccttatatccggcaggtggcggacagtcttctacctcatatccaagctcataatactttctcataagttctgctgctgcttttctccccggctcatctccatcaaggcagaaccggatggaagtaatctgcggatgttcccgaagaaaagtctcaagtggtgcatctgcaagcatcccaagtaccagcttatttgattcataatccgcgaagatatccacataactcataaggtcgattgcagcttcaaatactacaagctctgtactgttaacatttaccacattaaatccatagtttttatcatttcctgtgacatcacacttgaatggcttaccctgcttatcaaacactccccgcatacttgcaaatcttgtcactccatttttatcatttcctttgaaaacaacattgtggtaatgcctgctctcataaatcagtccatcttttaaaaacagatctatgacagtcctgctgattcctctctcctgattcagatatgaaataagataggaattatctcccgccggttccggtaggacaaatggctttctctcctctgcctgcttctgcgatacctgatgaacaagtggctgctttacaggattctcgatccttctatatcctgcaaaatctaaaagccagaacacagcctcttttacactcattccacaaaacacccgcaagaaatctatctgtgagccgccattgttgcctttgtcaaactgccttgaccatctgtaccaatggcttctgttgtaaatgcggatggaatccatctcttttaaagtgtggtatttgccaatcctctttactgtatacccaagactttctgcaactgcacacaggtcaacactctttgctatggcaagctcttcatccgtaaatcttccatccatgctttcaccttgcctttccctgctctgctacaagcggtgacttgatatcaagtgtccggtaatctgtgctcagggtaatcttaggattatcaatcattcctttttccctgaaactgaaaaattcacgattgtctccaccaactatgatatggtcaatgagtggtattcccatcagttcacacagcttgttcatgcggtctgtcatcatggtatcagccttacttgggaatacgttcccggatgggtgacaatggattaacatcatgctagccgcattgcttaggatgcttgatttaaacagttccctcggatgtgccattgcctcatttaaagagccaacacttgcaaaatgcacattgataggttttaaatctgaccttagattgaccacacacactacttccctgtcaaactggcacatacagtctcccatgacagcagctatatccgccggattgttaaaggtatgctccgaataaatcggagcatcctttacaagtcttaccgaaaccacatcaagcttgaagtcattcttctttggcatcagacaccgcctcctctccaaactcgacacggataacaaagtcacctttctgactgtttatgagagcaatgagttcttccattgtaagttcctgctccataactgcctcctatctggacttttccttcgcatcatatacaaggggaggttctgcaacgataccatcaagtctcttgtttggtgtatcagttgcaagtgtgagttttcttaaatccttatcatagtgatatacctgattggaaagtctctcgtccaaagacacctcctgcatatttacctcgactaccatctgtgcaagcatctcagggcttcccatatctgaagatactgcaataacctcatgcacgctcgaagggagaatataaaggtcactctctaaactctctgccagctcatgaagctcattctcataaagcatggatgctgcaccattgatacccttttcattggaaatcacccacatcgtctgctccggtggaatctcggctatcatcatatctgcaatctcctgtggcatcccatcccttgcgaacatttctttcataatgtcattcatgcttcgtactacaggtgggaagagtcttcttgtgttttccgctgcacacttaaagagctgttcctcactcattccaagtcttttcgcaaattcatttgtaatttttgaactctgcaccgcatccttatctgcactgattattaccttatacacaatagaaagatcctggaactctctgtgcggcacctgttccaaaaatgtcttattctgctctgtattgatgagctggaatacaatcttctcgttagcatccttcataatgctgtccacatcaacaaccggagcctgctcatatgccctttccataaaatcacatgcagccataagtgtttcctcaagatcaccacagtcctgatacttcttatacatgtcattgatataaatcgtaggcgaaatgttcctgccttcttctcttaagatgatgccatcaagagtcacattcaccttttccactggctctgccacaagctccattcctttgaacttctcaggcatataatccataaacttttcttttactacttccttaaaaatctcgtaattcatcatattacggttcctccttaatctaaaaaagcagggaacataagtcactggcttacattccccgcaaggttaattgttactgtttattctttttctttcttccacgaagtccgactccaacacctgtaataagtgcaagtgcaccaattccaagataaagaagcggatttgcattgtcgcctgtctgtggaagcttaggctctgtcggtacattgacaagcttaagagttgctacaacaacatccggtgcattatcatcatatcgaagtgttacatcgtgccatccacccttgcagtgaactatttatctgtaatgcacgggacacataggactgtcccgtattctgtgcatcttaaactccttttattataccagctctcttattttaaagaaatactgcataagtcttctgtttttcttataatttaagaataaaccctttacctgcatacgctcacctcctctcagaatgtgcccattcttacgaatgaaagaaatatccttgccaccatagcgaatagaagaagaattattctggcaagtcctaagaccagcttcaacgctccaagaattatccttaatatccacttgagtatctctaaaattactgttcctacggctcccataactcttctcataataatcagtctcctttcgacatccatcccattgcaagtcctgcaacatctgcatcgtccataacatcttctgtaggttcttgtgcttcactattggctgcctgcattattaccggctgaccaacattcatcccggatatcactccgcctaacagccttatgacctctttcctagcctcattggttgctacttcaatgacttcttccttaatatcctcaatatcttctgaccggatatattcagccctctctttttccttcttcttgataacaaaggtttcttttccataattatcaatatagaactgaatcgcatctatgatgaactggttcttagatttgaaaatcttcggatcaaggttctgaatcacatcattgattttcacatgctgaggattgctcatgttgaggcggacagaagtttttacttcatattcaagtcttcttcccatcatctgcctccttatgataatcgcttagtgcttttaagtcccattgtggcaagctgctcatatcctcttgcatttgcctttacatcaaggttataggaaatgttcttagcatcatgactaccaaaattcttcatcacaactgccccgcctccgacaaatacaatcggtgtagtttttaagttatacccaaactcacggattgagttatataccttatcgacaaaatcctctatctctgccttgataatggcaaagtattcatcatcaatatctgacctgccatatcgcatgatgttctgtatctctgactcatctacctctccgttaagctgtcttacacactgctcattgatagaacgcatacaggtaataagaccttttggaatcgttacacactttgattcatccggtgacttgttgattaccggcataatgtcgattgtccagcttccaatatctactatcagtgttttctttgccatagcaggaatcttgtccactactgctgcatagcactgaggaaatactgccacatcatcaatttcaatatgatacggctcattctcatatttgaagcttacacgcttattctttgtcaggtacttgataaaatcattcttctcagctccaaatcttgtaagtggaagtcctacagcaaggaatacttttgcctcttcaagacctcttcttttgagttccttagcaactgttgcaagagtgagaagataaaagctgtcatcttcaaccttggtatcctttacttcctgcctcacagttccaaccttatagaactttccttcatactcaagtacatcgccgaaaagtgccggagttgttgtaatctccttaacacctgtgacaaatacctgagagattgttttcatcattgaccagccatgatcaatgccgattacttctaacttgttattcatgttcctttcactccttttctgtattgtctgcattattgttttgcaaaatttcatataattacccacaccctttcaagtgctcagttttgtcagatgcaggaatatcatcagacctgccataaaaatgctttctcactaatttctcatacagttcatcactctctgccttaactttcataagacagtagagaaccactgtactaataatgattacgaaccaaattaacaccttgcccattcgaccactcctctcaaataaaaagaggaccaaatcagctgatggaatattccatctcaagtgctaatttagtcctcactaaatgtttttgatataaaattgtacctaatctaagcgcacagattcactctcagactgattgtggacatctgtgatgctgacttgaattttcggtttaatattgcagcgctgccctatctttaccgctaaaatggtataaaaataaggactaaattagtgctaaccccttgattttactgggtttctctaactttgtccttattataacgcgctcatcatctactacaatataattatatttttcctgcgcatatttctgatagttccgcatcatataagcaaatgaacaaatttcaatttgctcctgcagatctgggagagatttcttcactcgctgcctccaatcatcaataatgtttgtattaggagccataataagcgcatgaaattctgtattttttctggaaaaaatacgcaaatcttcttccacaatcctggattttccacttgccgttggaaataccacaagaaatgtatttattcccgcagcacgctgtttttgtatttcctcaagcgtattttcctgatgctcatataactttaccggacgatcagcaaggagtccattttcttcaaactcatcggtattttcaccaaaaaaagtttttatgtcatcctcaattcgattttcaaatctacaatcttctgaagaaaaacgatataacttaattccccattcggtacatgtattttgtttttgcagctgcctgcgataacgttccaaaccgatctgctgcggatgatgataagttaccccattttcttcaactgcataatccccatgctttgttcttaacaaataatccaggaaataattatttccctgtttatccaaaataccatattctttctgtaaatatttcaagctattacggccatatacacttgcaaaattattttcaaagtcgatttccaatggagaggcatctgcatgatcttcgcgatttgccacatactttattggtatttcttcctttttgcatgacaatgtaatcacttcattgattattcccatatcttcttttagaaagcgatatacttttgcatatttattcatatatgtattttgcttgtccgtaattaaagaataggaaaaaggtttctcatcctttttgtaattacatatcccatcatcaataataatagcctgctgatctcttacataaaaatagcttgcaccaccatttggatatgagactgtttctatcagatcatattgtccgttttccagctttaatactttatccattcgtcacactttcctcagtataaaattcagccattgttccgactcacggcctggtctcacatctcctgtcagccattgttcttctatctttacatgtcttataccgcttaaaaacccatcaaatgttttttctgtaaagtcagtaaaatatcttccatttcgttcgccctcaaatgttccatatttaaacgatgtataaatcactccatcatccttcaatgcacacaacattcgctgcataacatttttaagttcatcctttgacaaatgcaaaatagaggaacatgcccaaatgccatcatattttttctgctcgtccaactcctgaaatagcatatatttaaccgaaactccagtatatgtgcttgctaatttgcacaactcttctgaaccatccgttgcttccactctatatccatgttccataaaatactttgtatcacgaccagatccacaaccaaaatctaaaatatatgcatttggctgtaacaatgcaaggaacttatcctgcgttatggaaaaatctacgatttgtgtagtagcagaaaaaattgtagcattttcattgtagtattttaatgttgtattttcacgaaacttttcttctaattttctcatatatattccttgcggctattatccaactaatttttctaaccactctgcaattatttttctttctccactaccatttgtttgaaaacgcaacaatggtatctggtataattgcaatatgtgattcttcaacatatcccttgctgcttgtactgttccattcttatgatattcataaccatcaacttcaattgccaacaccggctttttgctaattctgttgtatataagaaaatctatatgcgtcgctggattcatagcatatttgcattcctgctcatttaataactccagatttcttattaacatgttcatcggaaaatggcaaacaacatccaaactggaatacctgctgtctctcagcagttcttcaattaatacgtacattaaattttccgaatcatattctgatatcttcttgtgattttttaaaaattcttttctttcttcagaatactgcttatacaaataatcaaaaattgaataaatttgactatctataacctcaaaattattatattcaatataattaatcagatcaataatattactctcttttgattgctcatttccagtaacaactaatataagttttttctttgcccttgacacagccacattaatcaaatatggatcatctgcaaaatcagatatctcatcatcaaccgttgatataataatattatccttttcttttccttgaaacttatgtacagtatcaacgtctattccatcaacttgattagctgtggcctttacctgatttttatatggtgcgataattcctgtttcatttttatcaaaattaaatttaggtattatttcatttttaatcacatctatctgtctttgactgtaatgatttctttcatgattaccgggaactgtttttattactgacaaaacatctttttcccctttatcttctgtcattataatcaattccccacgatagaatttttgattacagaaattaataattttaggatgacatctgtaatgttctctcaataatgtctgcgttacatttggtataacctccaaaatagattgcaaaaaactttttgtaaatcgatacccttcatttaggtgataactgtcaaatatagaatttgctttacccttaatttcctctgtgacaacatttggcaattgtttcgtatcgcctacaataaccacatttcttgcacaggaaagggccaaagctccagtcgctatatcaacttgcgatgcttcatccatgataagataatcatataccacatctgtatttagactatctcttgacgaaaatgtcgtacttaatataactggatattcttgtaaaagctcatacggatttttccacaagtcctcttctgtaaataacttacgttgattgcttttttcgtacttacataccaatttatcttccttgaatgaaaaactaaaacccaactgaaaatacgtctaataatcaaaattctttccaacagcttgtatattttatcatatcttcaagtcgttgtcaacaacttttttattttttctttgttgtctctcaaacgcgacaactctgatatcttatcatgtttgtcattatttgtcaacaacttttttcattttatttagaaaatatagagcggagaaggagggatttgaaccctcgcgccggtcaacccgacctatacccttagcaggggcacctcttcggccacttgagtacttctccagatattttctatataaaattacgtccttacgtgacgcattgtttattctactaaaaacagtcctttttgtcaacctcttttttaatttttattatatttctgatgcaaatttcttaattgacgtctcatatagattatttccatcctgatcgattactacaatggccggaaaattctctacatataactttcggattgcttctgcaccaagatcttcataacatacaatctcggattttctgatacactttgagagcagagcacctgctccacctactgctgcaaaatagactgcatgattgcggataatcgcgtctataacctcttttgatctctttcccttgccaatcattgctttttcaccaagatcaagcagggtaggggcatacttatccatacgagtggctgtagttggtcccgcagatccaatcggacgtccttcacgggcaggagaagggcccatataatatatcgttgcatctttgatatcaatcggtaattgatctccccgatccaatgcttctatcatcctcttatgtgcggcatcccttgctacatagattgtccctgtgatgtatacataatccccggaatgaagtttttttgtcacttcttctgtgatgggtgttgtaatatgctgatccatacctgttcctccttatatcgttctgactgcatgacgatttacatgacaacagatattaactgccacaggaagccctgcaatatgtgtcggataagtatttatattaacagcaagggcagtagtggttccacctaatcctcccggtccaataccaagcttattgattttttccagcatttctttttccagatctgcaacataaggaatctcagaatgttcatttaccggccttgtcagtgcttttttggccagaattgcacatttttcaaatgttccaccgactccaacaccaacgaccattggaggacacgcgtttggtcctgcatcttttacggcagtaagaatcgcattttttactccgtctattccatccgcaggttttaacatgaaaatacggctcatattttcacttccaaatcccttcggagcaaatgtaatcgtcaccttatctccgggaacaatcgaatagtggataattgccggtgtattatctttcgtgttttcacgaagaatcgggtcagctacaacggatttacggagatacccttccgtataaccctgacgcacaccttcattgattgcatcttccagccattgcccttcaaaatgcacgtcctgaccgatttctacaaaaaatacagccattccggtatcctgacagataggaatcatttcttctcccgcaattttaagattttcctgcagctgcagaagaattttttttccaagttcggatttttcttcttctgcagcctttttcatggcatgttccatatcttccgcaagaaaatgattcgcttccatgcacatttcttttatatttcttgtgatttcttctgtctgtatggtccgaatcatgatggatcaccttccgtctcattttcttctgttgcttcttcttccggtggcatcagtgatttatcttctacgactcttgcaatgcttgcaaccgtcacaccacttttgagatcaatcagttttacaccagaggttacacgtcccagtaatgccgtatcatttacgcgaattcgaatgatgattccttctgttgtaatcaacatcagttcatcatcttttacgacagacttcactccgatcagatttccagatttttctgtgattttatagcattttacaccttttccaccacggttctgtgttgtaaactcattgatccgtgtacattttccaagaccgttctccgatacgatcatgacggactctccctgggaagccatctgcatggcaattacttcatctccggcagtaaggttcattccaatgactcccattgtcgtacgaccggttgcacggacatcggcttctttaaaccggatacactgtccataccgggtaaataacagaatttcttcatcatccccggtaatttttacttcgatcaattcatcatcatcacgcagactgatcgctgccaatcctgttttccggatattttcatagtccagcacggaagtttttttcactattccgtttttggttgccataaacagatatttatccttctcataatctttgatcgggatcattgcggtaatcttttcatccggctgtaacggaatgatattgataattgcggttcctcgggaagtccggctggcttccggaatttcatatgccttaatccggtacacacgtcccatattggtaaagaacatcaggtaatggtgggaggttgtcataagcatttccacgatataatcatcctgaatggtctccattcccttaattcccttaccgccacggtgctgactcttgaaattgtcggttcccatgcgcttgatatagccaacctttgtcatggtaatgaccgtattggtttccggaatcagatcttccatggaaatatcaaactcatcgtatccgatctgggttcttctgtcatcgccatatttatctgcaatttccagaatttctgtgcggataactgcaagaagctttttctcatctgcaagaatcgccttgagttccatgatctgtgccatgaggtctttatactcgttttcgagtttctcacgttccaaaccggtcagggtcttcagacgcatatcaacaattgcctgtgcctgtgcatcggataatccaaaccgctccatcagggaattctttgcgtctgcagttgtacggcttccgcgaataatggaaatcacttcatcaatgttgtctaatgcaatgatcaatccctgtaaaatatgcgcacgttcttccgccttgttcaggtcaaatctggtacgtcttgtaataacctctttctggtgaatgagataatagttaagtaattcatataaattcagaatttttggctggttatccacaagcgcaaggttgataacgccaaatgtatcctgcatctgtgtgtgtttatataataaattcaaaacaacacttggatttacatctcttcgaagctcaataacaatgcgcatgccttcgcggtcagactcgtcccgaagatctgtaattccatcaattcttttatctttgtgcagttctgcaattttttcaatcagtctggctttgttgaccagatacggaagttcggtgacaacaatacggttttttccgttatccatcggttcaatatctgtcacagcgcgtacacggattttaccacggccggtccgatatgcctcattgataccggcagtacctaaaatcacacctccggttggaaaatctggtcccttgatgatgttgattaattcatcaatgtctgtctctttctcctcaatatcgttgtcaattaatttcacaacggcatgaatgacatcccgcagattgtgaggaggaatatttgttgccataccgaccgcaatacctgtcgttccgtttaccagaaggttcgggtagcgcgccggaagtacggtaggttctttttctgtttcatcaaagttcggggtaaagtcaacggtatctttgttgatgtcccgaatcatctgcatggaaatttttgaaagccttgcctctgtgtatcgcatggcggcagcaccgtctccatccacagaaccaaagttaccatgtccgtcgacaagtggatatctggtcgaccacggctgtgccatgttgacaagtgccccgtaaatggagctgtccccgtgcggatggtatttacccatcgtatccccgacaatacgcgcacatttacgatgtggcttgtccggtgtattactcagttcgatcatggaatacaggacacgccgctgtaccggctttaatccatccctgacatccggaagcgcacggcttgcgataacgctcatcgcgtagtcgatgtaggaggtttccatcgttttcttcaggtcaacctgttgaatttggtcaaatattttatcgtccactgatctgctcctccctaaatatcaagattctgtacatacttggcattttcttctataaattcccgtctcggctctactttatcacccatcagagtcgtgaatgttacgtcaatttccgatgaactttcgtcatccatcataacctgttttaaaatccggtgctccggatccatggtggtttcccataactgttccgcatccatctcaccaagtcctttgtaacgctggatcttattattctgatcgcgcccgatttccacaagaatattgtttaattcttcatcactgtatgcataccagacatttttgtttttctcaattttgtaaagcggcggggtagcaagataaacatgtccctgcttaataagctccggcataaaacgatacaaaaatgtcagcatgagtgttgcaatatgtgcaccgtccacatcggcatctgtcataataataattttgttataacgcagcttggatatatcaaaatcttcatgaattccggtaccgaacgccgtgatcattgccttgatctcggcattatcataaatacggtcgagtcttgccttctccacatttaaaatttttccgcgaagcgggagaattgcctgtgttgcacggcttcttgcagtttttgcagaaccaccggcggaatctccctcaacgataaagatttcacaattttttggatttttgtcggaacaatccgcaagttttcctggaagggcagtaccctcaagtgctgtctttcttcttgtcagatcacgtgctttccgggctgcctctctggcacgctgggccagcagcgatttttcacagatatttttggccacatccggattctgctccagaaaatacgtcagctgttccgtaaccacagaatctacagcaccacgtgcctcactgtttccgagtttctgtttggtctgtccttcaaactgtggctcttcaattttgatactgataattgctgtcaatccttcacggatatcatctccggtaagtgccgcatcgctgtcttttaaaatttttgcttcccgcgcatacgaattaaacgtctttgtcaacgcatttcgaaaaccggcaagatgtgttccaccttccggcgtaatgatgttgttaacaaaactaaacgtggaatcgttaaaagaatcattatgctgcattgcaacttccacgtaaactccgtcacgatttccctcacagtaaataacttccggatataacggttcttttccgcggtttaaatactccacaaattccttgattccaccggcataatggaatttatgattatgcagactatcttccctcgtgtcttttaatgtaatgcataatccttttgtcagaaaagcagtttctcttaaacgctgtttgagcgtgttgtaatcatatacggtttcttcaaagatttccgcatccggcagaaaatgaacctttgtaccgtgaagttgtggatcacagtcccggactgccgctaccggtccatccgcttttcctctcttgtaactttgcatatacacttttccgtcatgatatacttcaaccgttaaccaggcggagagggcattaacaacagaagcacctactccatgcagtcctccggatactttgtatcctccgccgccaaactttccgcccgcatgcagaacagtaaacacaacttccagtgcagacacaccggctttgtgattcattccgacaggaattccacgtccatcatcttcaacggttatggaattatctttttctatggtcacctcaatgtttttacaataaccggcaagtgcttcatctaccgcattatcaacaatctcatagaccagatgatgcagtccgcgtgcagatgtacttccgatgtacattccgggtctctttctgactgcttcgagtccttcaagaatctgaatctgatctgccccatattcctgattattatttgttaattcgctcatcaatttcctcctcatccaacggatgaacctttcctttatatctcttcaaccgattccttttcataaacatttccgtttatcacctggaaaattttgttgatacaaaaacggttctttacaaattcctccaaccctgtacatgtaatgacagtctgtattttagcaatactgttcagcaggtaattctgtcggttactgtcaagttccgataacacatcgtccagcagcaacaccggagtatcatgaatggatctcctgaccagatcaatctccgacaatttcaaagaaagtgctgaagtacgctgctgtccctgagacccaaacttacggatatccacatcatcaacggaaaacagcatgtcatccctgtgtggtcctaccgttgtctggcagagtttcagatcccggttctgtgcccgcagcaattcatccgcaaaaagatcagcggtaatatttggctcatactttaataccagatgttccctgccaccggaaattttagaatggatttccgaaataatttcattcagtttctccacaaattcttttcgtttccggatgattcttgttccatactccagtaactgcatatcccacaccggaagagtatccacaaggtccgggcgaaaagaaatatctttcaacaatttgtttctctgattcaacactttgttgaaactggataaatctgacaaatatagtttatccaactgacagagttctaaatcaataaatcttcttctctccgcaggtccgttttttataatatttaaatcttcgggcgaaaagaaaacgatattgagtattccaaacaactcacttgcctttttgatcggaatcttattcacagccacgccttttgatccactttttctaagatgcatatcaatctggtactctttttcttttttctgtacgacagtacggatatgtgattctttctcaccaaaccgaatcatctctttatcacggcttcctttgtgggattttgttgtaccactcagataagcagcttcgagaatattggttttcccctgtgcattgtctccgtaaagaatattggttccttcatccaggtgaatatccagattttcataatttcgaaaatttcgcagctcgattgattttatgatcattgaactatctgaattgtttcaccctgaaaggtaacaacatccccattatgtaatttttttcctcgttgaagttctgtctgaccgtttaccgaaacctgcccatctaaaataaccattttggcatccacaccggaaccaacaactccggcttttttcaacgcctgtccaagtttgataaattcgtcttcttcacggatatttactgtaatcatgtaatctcctaatttgcagcattattaaagttaacaggaagaataagataaatgaattttccttcatcatctttgataaaacatggagcttttgggtttaccatataaagacttacattttcttcatcgataacacgcaacgcatcaatgaagaattttggattaaatccaatcaggatgtcttttccttctttctcgatatcgatatcttcattcatggaaccgatgaaagaattgatttttaactccatactttcatctgtgatattcataatgatcggctttttgtcaccttctttgacaagaagagtagcacgatcaatacaatcaagtaattcttttttattgactataactttcgtttcataagcagatgagagcatctgatcaatgcggaaatattctccttcgatcagacgggatacaaccgtagtagtatcaaattcaaaaacgatatggttgtccgtcaggtagatgagtacatcatcatcaactccacctggaacaattttgctgatttcctgtaatgtttttcctggaacgacaacctttttattttcgtaattatttttaagttctatattacgaatggagatacgatgaccatcaagagaaacaactttcagttcattctcattaatttcaaacagttcacctgtcataagtttgttattgtcgttatcagcaatggaaaagattgtttgtctgatcacttccttcagtgtgaactgggaaatcacgattgcatcatttttttcaatgtatggaagatatgaaaaatcatctccggattttccaacaatattgaattttgctttttcacaggagataactgtcttaaaggaggcatctgtttcaatcgtaacatcactgtctggaagtttgcgtacaatttcagaaaagatttttgcatccagtgcaataactccacgttccgcaatttctccttctacacgggtttcgattccaagttccatatcgtttgccattaatttaatttcattcgtagaagcatcgataagaatacattcgagtattgccatagttgtacgggtaggaacagctttggatacgatatttactccgcgcaataaatttgatttagaacagatcagtttcatgaaaaactccctcctggtataaataaaaatatattaagacattcgtcttagtcttaataggggctgttaatatgtgaataagcctcttcatgttagatgttaagcggtttccggcgtttgataaccggcttgaaagcatgtgaaaagtgtgaggattcttaaggtccgtctgtggaacaaattttaagagatttacgttaagaacctcatgcacaatccatccactgtggataaacgtgaataagttgaaattaaaaaaagcaaataaaactacattataataggaagaaactcatttaatttggatttattttctttttgatggtttcaatcatatttcttgtagtttcgtttttttcgtattcttcggtaactttcttgataccgtggataattgtggaatgatcgcgtccgccgagtaaagaacctatggtatccagtggactttcggtcatatttttacataaatacattgcaatctggcgtggttttgcaacatcactgcttcttgtctttgaaatcatctgatctacagagatgtgataatgttcagaaacaacttcaataatgagctgtggtgtgatttcccgtggcttgtccggcgtgataatgttggaaagttccttttctgcaatatccatggtaattggaatgtggacaagattgttataagcaagaagtttatttaatgctccttcaagttcacgcacgtttgatttaatgttgtttgcaatgtagcttaatacttcatcatcaatgtcaaagttatccgattcggcttttttccggagaatagccatacgtgtttcataatccggcactccaatatctgccatcagtccccactcaaaacgggaacggatacgctcttcaagggtttccatttcttttggtggtttatcggatgtcagtataatctgttttccctgtgtctggagtgcgttgaatgtgtggaaaaactcttcctgtgtactttcttttccgatgataaactggatatcgtcaatcataaggacatccactttccggtatttgtcacgaaattttgtcatggatgaagcattaccgtttcgaatggattcaattacttcattcgtaaattcttcggatgtaacgtagataaccttggcatccggattctggtttaaaataaagtgcccgatggagtgcataaggtgggtttttcccagtcccggaccgccgtaaatgtaaagcggattatatgcttctcccggagattctgcgactgcaagggaagccgaatgtgcaaaacggttattattaccaacgacaaatgtatcaaatgtataatttggattaagattagattcatctgcggttacggcaggtgtagcttttgctggttttgtgtttaatttcagcgtcctggcttcttccggaaggatgaatttgatttcatattcaatttctgtaatttccacgatcgcaacgcgaagtggtgcaaggtacttcttggaaatatagcttaaagccatctgttcggaaggaaccaggatatagagagtatttccctcaatggcaaagatttctaagggacgaatccacgtatcgaaggagacatcactgatttcgtactcctgttttaccgtatttaaaatttcatcccatttttcaataatcttatccatctgcttttctccacattattcttataaaaaaggatactatcccataatcctattcctatctataatacaccattttcggtatagaatcaactttttagacgtccttttatatttttcaaaactaacatataaacatatggataaaaggcgaaataatgcgtttcagggatatggaggtatggtatggatgttgatggaaacagagttatccaagaggtattgacagtttatccacaagttatccccaaattgtggataacttattatttcgtggaaaagtgtggatactatatatagtggactgcttttcttccttattatatgtagtgtttataacattaaattaggaaaaaaccttgattttacttgacttgtagcgtttttctgatataatgctaagtgatgttttttaacgtagaggaggtggatacgaaatgaagatgacattccaaccaaaaaaaagacagagagccagagttcatggtttcagaagcagaatgagtactgcaggcggaagaaaagtattggctgctagaagattaaaaggtagaaaaaaattatcagcttaggccacattattgtggtcttttcttctattatgaggatattttcagatgaagttctcagaatcattaaagaaaagtaaagattttcagaatgtgtataacaaaggaaattcatatgcaaaccgtttattggttatgtatgttctggaaaatcacacagacaaaaacagattaggtatatccgttagtaaaaaagtaggaaatagtgttataagacatcatttgacccgtctgatcagagaggggtaccggctacaggaggacatgttcaatagtggtttggacattgtagtcatcgcaagaggaacagcgcgtgatgcttcgtttcatcagatttcgagcgcactgaaacatcttggaggtcttcacaaaataatacattaatatggaaaagaagatggaattctattgaaaaaattacttattgcatgtattaaattctatcagagatatatttctcccatgaagtcaacgaaatgtccgtattatccgacctgttcctgttatggactggaagctgtgcaaaagtatggtgcgataaagggtggggcactggctgcctggagaattttgcgatgtaatcctttttctaagggaggatatgacccggttccataaaccaaatggaggtttttatgtcaggcatgattgaattgacagcgtattccggaaaattcctcggaccgattgcaaaggttcttggatggatcatgagcggaatttacgatattgttttaaaaatttccggtggtacgatcaacagtgtaccgcttgcaatcgttctcatgacgattttgatctatatgtgtcttttgccattgacaatccagcagcagaaattctcgaaactttcgcagaaaatgcagccggaactgaatgcgatccgtgataaatataagaatcgcaaggatcaggaagccatgatggcaatgaatcaggagacacagcttgtatatcagaaatatggtatttctccatccggaagctgtatccagatgcttatccagatgccgattttgtttgctttatatcgtgtattttataatattccggcatatatcggaagtgtgcgtgattctttttatacgatttccggaaacgagacgtttcatggtctggtcggtggaattatgaataccgatgggtttgtgaaaaaagtttcggatttaatgacaaaatttaatgtggttacatccagtggactgaatataaaaaatgttgcagatactttaaacggagcatcgggaaaggatcttgccaattatattaccgatattgtgtacaagcttccatccacagcgtgggataagtcggtagacggcagtattttccagcagttttcgtcacttacggatcagattaattccacaatgcatgatatgaaccattttaattactttctggggcttaatatttcggataccccgtgggcaattataaaaagcagtatggaaggtcatgcgtggctgcttgtgattctggcggttctgattccggtattgtcttatattacacaggtgatcaatatcaagttgatgccaaccgcagctaccgcaggtggggataatgatcagatggcaagacagatgaaaactatgaataccatgatgcctctgatgtctttgtttttctgttttgtgacaccggttggtctcggtatttactggattgccagtgccgtgtgccgtgcggttcagcagttctttatcaacaagcatattgaaaatcttaatcttgaggatattattgcaaagaatcaggaaaaggtgaaaaagaaacgggagaagatgggcgttactgaggaacgcatccgtcaggcagcggcaatgaataccagatccatccagtcgaaggcaaatgtttcttctgcaaacagggaactggaacttgaaaaggcaaatgcagcgaaagcaaatgcaaagccgggaagtatggcagcgaaagcaaatcttgtaaaagaatttagagaaaagaataatcgtaaataagagggggcagttatatggagtttattgagatttctgctaaaaatgtggatgacgcgattacacaggctactgttcagctgggaataaccagtgatcagcttgagtatgaggttcttgataaaggaagtaccggttttcttggaatcggaagtaaaaatgcagtaattaaggctcgtaagaaattttccattgatgagaatgttgttgaatttttatcttccatttttgatgcgatgaagatggaggtagaaattctcgttgcagtaaatgaggaagaacatatcattgaagtagagttaaagggagatgatatgggaattctgatcggtaagagaggacagacgctggattctcttcagtatctgacaaatcttgcaatcaacaaacattccgatgaatattataaggttaagattgatacggaagattacagaaagagaagaaaagagacacttgagaatcttgcaaagaatattgcgtacaaggtaaagcgcaccaagcgcccggtttctcttgaaccaatgaatccttttgagcgacggatcattcattctgcacttcagaatgatcgttatgttacaacacacagtgaaggggatgaaccatatcgccatgtagttgtaacattaaagaaataaggaactgactgatagagttaaaaaataaggtgaatatccagttttgggtattcacctttgtttagaattggagagacttatgaattcagatacaattgctgcaattgcgactgcgatgtctccttcgggaattgggattatccggatcagcggagaagacgcgttgccggttattgaccggatttatcgttcgaaatatggtcataaaaaattgagtttatgtgaaagtcataccattcattatggatatatttatgacgataacgagatggtggatgaagtgatggttttactcatgaaggcgccacattcttatacaaaagaagatacggtggaaattgactgtcatggcggtgtctatgttatgaaaaaaattctggaaacagtaatcaaacatggtgcacggccggcagaacccggcgaatttacgaaacgggcatttttaaatggccggattgatctgacacaggcagaatccgttattgatgttatcaacgcaaaaaacgaatttgcactgaaaagttcactttcccagttgcagggggcagttcttgtggatatccgaaagatccgggcagatatattgcatgaaattgcctttatagaatctgccttagatgaccctgaacatatttctctggataattatccacaaactttacacaatactgtggataacttggttataaaaattgataaaatcctcaaaacctttgaaaatgggcgttttctgaaggaaggtatcaacactgtaattgtgggtaaacccaatgcaggaaagtcttccctgttgaatattctggtaggagaggaacgggcaattgtaacggaaattgcgggaacaaccagggatgtcctggaagaacagattaacctgaatggaattacattaaacgtaatggatacggctggaattcgggatacggaagatgtagtggagaaaatcggtgtggatcgggcgagaacatatgcatcgaaggcggatctcgtaatctatgtgattgatgcatcgacagagctggatgaaagtgattatgagatcatggatctgttgcaggataaaaaagcaattgttttattaaacaaatcagatctggacacaaaagtcacagtggaagaggtacagcatattctggataaaaagattattccgatttctgcaaaagaacatcagggaattgatgaattggaagaaacgatccggaatatgtttttccagggtgaagttacttttaatgatgaagtttatgcaattaacatgaggcagaaaacgtcacttcaggtagcacttgatcatttacatcaggtaacacaaagcattgaggatgacatgcctgaagatttttattccattgatctgatgggcgcgtatgaggagctgggtaagattatcggggaagctgttgaggatgatctggtggatgaaattttttcaaagttttgtatgggaaagtagcaggtaaaaaaatgggtaagaaaaatattccttatattgaagaaacatatgatgtggttgttgtcggtgccgggcatgcaggttgtgaggcagcattggcatgtgccagactcggattggaaacaatgatgtttacggtaagtgtggacagtattgcactaatgccatgtaatccgaacattggtggaagttccaagggacatctggttcgggaaattgatgcacttggtggagagatgggcaaaaatattgataaaacatttatccagtcgaaaatgctgaataaatcgaaaggaccggctgtacattctctccgcgcacaggctgataaagcggaatacacaaaagaaatgcgaaaaaccctgcaaaatacggatcatttatccataagacaggcggaagtcgcagagatattaacaaataaagaccagtttttctcggaagatgaatatcatgaaggagaagaacagaaaattaccggagtgcgtacagtttccggaggtgtttacagatgtaaggcagttgttctttgtacgggaacttatctgagagcgcgctgcttaaccggtgaaatgattacacatacgggaccaaatggattatcagctgcaaaccatctgacagattccctggttgctcatggtatccagacaagaagatttaaaacaggaacaccggcgcgtgtcgataaaaggagtcttgatttttcaaaaatggaagagcagtttggagatgaaagagtcgttccgttttctttcacaacgaatccggaggatgtgcagatcgagcaggcttcctgttggctgacctatacaaatgaaacgacacatgaaattatccgaaacaatctggatcgttctccgatttatgcgggaatcattgagggaacaggaccaagatactgtccgtccattgaagataaagtggtaaaatttgcagataaaaacaggcatcagatttttattgagccggaaggacttagtacaaatgaaatgtatgtgggcggaatgtcatcttctctgccggaggatgttcagcatgaaatgtaccggacacttccgggactggaacatgttaaaattgtaagaaatgcatatgcgatagagtatgactgtattgatgcaaacaatttgtatgcgtctcttgagtttaaggcaatgaaaggtttgttcagcggcggccagtttaatggaagctccggatatgaagaggctgcctgtcagggattgattgccggaatcaatgctgcaatggaaattaagggaagagatcctctgattcttgacaggtcggaagcatatatcggagttttgattgacgatcttgtcacaaagaaaaaccgcgaaccttaccgcatgatgacatcacgagcggaatatcgtttacttttgcgccaggacaatgcggatttacgcttgaccaaaaaaggatatgaaattggtctgatttcacaggaacggtatgactgggtttgcaaaaaagaggaactgataaaaaaggaaattgagcgcgtgaatgaagttaagctcggggcgaatgcgagggtacagaatgttctggaacaatatggaagtattccacttcataccggtacaacgctttctgatttgattcgcagaccggagcttgattatgataaactggcagaaattgatacagaccggccggatttacctgcggaggtaacagagcaggtgaatattctgatcaaatatgatgggtatatcagcagacagattaagcaggtagagaagttcaaaaagctggagaagaaaaaacttccggagaaatttgactataatgaaatttcgggacttcgaatcgaggcacaacagaagctgaatgagttccagccgttgaatatcggtcaggcatcacgtatttcgggtgtcacaccagccgatatctctgttcttctggtctatctggaacagttaaaatattcaaatccagatttattttttaagttaaacccggatgaacaaaaagaaaaacaagaataatggaggattctatggaatataatacagaccattttctgtctatgcttgcaaaaatgaatatttcattatcagacaagcagttgcagcaatttatgacttattatgaaatgctcatcgaaaaaaataaggtgatgaatctgactgccattaccgattttgatgaagtcgtcgagaaacattttgtagatagtgtttctctgatacaggttgtggatcttcatcatccgttaaaagttatagatcttggaactggtgcggggtttccgggaatcccattaaaaattgtttttccggaattaaatgtggtgctggctgattctttaaataagagacttgtttttttgaatgaagtgattgatgcgttaggactgacagagatctatacggttcatggccgcgcagaagatctggcgcgcatgcccgaatatagagaacagtttgatctgtgtgtttcacgtgcggttgccaatttatccacacttgcagaatattgtcttccattcgtccggttgggtggaaagtttatttcttataaatcgggagagtgtgaaaatgaagtggcagctgcaaaatcagctatttttcttctcggaggaaaagttgaagatgtgtataagttttctattggagaggcgcagcgtgcattcatttctttaacaaaggcaaacggtacatcaaaaaaatatccaagaaaagccggaatgccctccaaaaatcctttgtaatttatgcttttttccactgctttgagcggaaaaaagatgttatccacatttatggatgagttataaaaaatggactgtacctttgaggtacagtccatttccaattaattggataacttgttttcgataatttggtaaaccttttccggattctccagttgtggatacaatttgcaattggaaacataggtgatgtctatgttagaattcagtttacgatattcctgtgctgttttgtagtttgcttttatatcgctgctgataataaaagaaacaggttttgtgatttttttcacagcatgccgaaggtcaatattcatataattgccaagaagacttgagtataagtattttccattactgttgtccatatgggctgcttcatagtaggcatctttcgttttggaagaaatcagctgaggtctgcagtaataggtaaaacggaactgacggtcaatacgtttcgggttcatgagcaaattatagataaaggttccgaccaaaggaagatttatgatcgtttgctttagtttactttgctgatccggcatggcatccatggaatggaaggaaaccggattaataaaaatcattttgtcaatgatggaggcatccagttgatttgccataattacaaatgaggaggagaagtttgaagctacaactgatgttttggattttataatatctttgataaaagcagtgatcagctggacatacatatagttggtataactcagccctggtttgtcggagagaccgcagcccagaagatccatggtatataccgtatgtttcttttgaagtctttttgaaatttttgaccactcaacagatgaactagcggaatttgtgtcatgaataagaagaacaggatctcctgttccagtttttgtgtaaaaaacatttccctgtttccaggaataataggatccgtttttggttgggagcatattcttttttgtggaagtggaggcaacaaactgattgtatgcatacattcctgccagtgttgcaacactcaaaaaaagaaatttttttgtgccttttttcatggaaatcctccttgtatttaaaatttgtttgattttaaatatattatagacatttttgggtctttttacaaacaatatttatttctttattttctttacccgtaaaatgatttataatattattgatattgaaaatacaaaacagaacatacgtttgaggaataagatggtaaaagattatctggaaaaaatccgtcaggagtatatagaacacaaagtttctctggaagagcagatttctttatatgaaaataaagtaaaagagaatacaaagtttcttcaggttttagagaaggaaacaaatcccgggtatgaagcgttcagtccgagagaatttaattcttttcataaagaaaagatggaagaacttcgggcagatcaaaaaaggatatcaaatgaaattatgtgtctgagagatcagatgcaggaatatgaatttcgaattgcagatattaccagcgttatcaaggaagaaacggagattgaaagaaagattcatgaggctgcggatatagattcttatgataccaggctggcattacttcgttctgttgaaacagagcgtcagagaatagcgcgagaattacatgattctaccacacagaatctgactgcaattgtacataaaacggaattatgctcaaaaattatagaatcagatccggtaaaatgtaaattagagctattttccattggtcagacactccgtaaaataattgaggataccagagggttaatctatgatttaagacctatgtcttttgatgacattggatttgacgttacggttgaaagagcattggatcgatttcagagattccatagaatagaatgtggatattatacggaaggtacatcatatccgattaacagtgttgttcagattacattgcttcgggtgattcaggaggcatgtaataatgcagttaagcatgcacaggcatcttatctggaggtaaaagtttcttatttagaaaagaagattgtattagttattaaggatgacggtaagggatttgatgtaaatgcagttcccgatgagacaagggatgataattccggattcggattgtctatgatgaaagaaagggtctatctgttatcaggaacaatttctatagaatctgcacctggaaagggatgttctattattgtgtcaattccaaaaatgaaggaggacttataaaaatggcaattaaaattatgatcgcagatgatcattccatgatcagagagggattaaaaagtttactggaattggaaggagatatacaggtagttgcagaagcagaagatggtgttgactgtctggaaaagttaaaaatttgtacaccggatgtattattgcttgatattaatatgccgagaaaaaatggtctggaagtattgcaaacgcttaaatcttcaaagtcaaagataaaggttttggttctcaccgttcataatgaagtggaatatctgatgaaagcggtcgatataggggtggatggctatattttaaaggattctgaatccgcagaattgaaaaaagctatattttccatcgtagaaggagaaaattatattcagccaagtcttattccatcattaaattccaagatgattgaaaagaacagggatgaaggaaagatagagagtctcacaaagcgtgaattggaagttttgaaacttttggcagttggaatgtataataaggaagttgctgaaaagttaaatatcagtgagagaaccgttaagaaccatgtatctaacatttttaagaagatagaagtaacagatcggacgcaggctgcagtgtttgctattcgcaataatttaattgaattgtaaaaagaatggaaaacgagagagtttcgtttaaaaaaggataacaaaatgtttcacgtgaaacattttattatccttttttattttcataagtagaatttgctggagagcagtttaaatataagtttgcccggtgaatttatgatatgcatgattttgctccggttttacaaattaatgaacgaatgataaactaccggaacaataagaacataatatgaatgaaagttttgggaatactttcttattaagcccatcggtagaaaaataaattttatagttgtcccatttattaccttcttttccctacatatccagttcatcccgatttttaaagtaacatcactaatcatatcttttaaatttttatttaagagatcaagcagttactgaataaaataatgttccgtttatcatcagatcagtggtgaggacaattttatcatcgtttcggaataaatataattatctttttatctgtcaaatggtgcagagggtaagttgctacaatgtattcatacttctgatatttcataggtttcgctaatctcctgaatagtcgtatcttatataccctgtaaatgtgtctgcattatttccaggattttgtaattcttttgtaaaatctttctgatatgggtgtacccagggatgtgccggagatatgtttggtacttatcagtatcgtttccttgaaaatttttccatgaaattatgtgattaaaaggtcataaggtatgattgatgcatgtttgcatgcaatttgatggataccgtaatgacccgcaccacaattgagaaagtagcaatttactatgcaagcatgtaaattaacggattatgagatgcggtcagattatgagaatgcgaagcatgtagtaatctgattaatcttaaatgaggggcaaaatgtctttttgacactcatatcattatatctatatccatataaatagatatagatatagtcacgccgtgagagtaccggtgtcaaagcctattggattctcgaaaatatgtaacaaacgtgcaaatatgttatgagagtatcagtgtcaatacccatatccatgtatggttacttttggtgttttatttttgtaccatagaaaggagtgaataaaaagcgtaaattaatatatttctgggaaagctataactgtcaaatttaacatcctatttttcacagacaggtgctataaatattatttctttgtctatagtttcttttattatgtgtagaaagagattgtatcttttctttcgtcttatagaacagaatatcttctttcttgcgttgaaatcaatacgaaacagagtattattcatcgtgtagaaaaaatgtcttttaagtaacactatgtatatcaatccaaaagaagatataaaaagatttccaatctacgtatttaagctgcgattccgtttataataaaaagaataaaaaataaaaatgtttcacgtgaaacatttcacaaaaaaagctcaaagaagaacataaaaatctgcaaaataacaacataattactattcgagattaatcgattttatgttatactgtaatagaaaataagaggaaaatgtgtatgatatataaaagtatattattgattttgggatatctatacggaacaatgttaactgcaacgttcgttgtaaaacattccacaggaaatgatgtaagtaaaataggatctggaaatcccgggatggcaaatgtcatggaacatatcgggaaaaaggaaggtgttttggtattagccggcgatatattaaaagttattgtagccggtattcttggtcacctgttatttccagataaaacatggcatgatatttttttatatacaggatttggagcaatttttggacataattatccactgtggagaaaaggaaaaggtggaaaaggtgttacagttacctgtacgtggttgatacttacatttggagttctgggagcaatctgttgcataataggaggcatggtagtgttacttaccggatggcttccgctgggcgcggttgtcattcctgcgcttgcaattccaacggtatattttatacatggaaaatctatagaacttgtatgtgtactgattgcaactgtccttatgctgatccggcatcgcaaaggaatttacagaataatacatggggaagaacctttgcatttaaaaattaaaaaggataaataaaaatacactctatatacagagaataagaaagaaaagaggaaaatatgggaagaattattgcaattgcaaatcaaaagggtggggtcggtaaaacaacgacatcgataaatcttgcagcaagtattgctgaaatgggcaaacgtgtacttgctattgatttagatccgcagggaaacatgacgagtggacttggcgtggataaaaacgaggttgagaatacggtatatgagctgatgctggatgaatgttccatcaatgagagtattcaggataccgttgtaaaaggcctgcgtctgattccatccaatgtaaatctggcaggtgcagaaatagaattattaggaataaatgataaagaatatatattaaaaacggcagttgactatattcgtgatgattacgatttcattgtgattgactgtccgccatctttaaatatgctgacggtaaatgccatgacaactgcagatacggttcttgtcccgattcagtgtgagtattatgcactggaaggactgagccagttgatacataccattaatcttgtacaggagagattaaatcccaatctgcagatggaaggcgttgtatttaccatgtatgatgtccggacgaaattgtcaaatcaggttgtagaaaatgtaaaagaaaatctggatacaaaaatttatgagactatgattccgagaaatattcggttggcagaggcaccatcttatggaattccgatcaatatgtacgatagcaaatctgcgggggcagagagttaccgcaagcttgcaaaggaaatcgtgggtcgtaaagatttgtaaaaagaaagggagtaacaatggcagttaaaaaaggattgggaaaaggtttggattctctgattacagacaaggtgaatacaaaaccggcagtttcaaaaaataatccaacaccaaagagtgagcacgcggcagatgctatcatgatgaatatcacaaaggtagaaccgaacagggagcagccgagaaaaaaattcgatgaggatgcattgcttgaactggcagaatccataaaacagtatggagtattgcagccacttctggtgcaggagagggaggattattatgagattgtcgccggggagcgccggtggagagccgcaaaaatagccggaatcaaagaaattcctgtgattatcaagaaacttaccagacaggaaattatggagatttccctgatagaaaatattcagagggaagatttaaatccaattgaagaagcactggcttttaagaggcttctgacagaatttaatctaaagcaggatgaggtagcagagcgggtttccaagagcagaacagcggtcacaaatgccatgcggctgttgaaactgaatgaaaaagtacagcagatggtcattgatgagatgctgacaacaggacatgcacgcgcacttctgggaattgaagatcaggaacagcagtatatcattgcgcagaaaatttttgatgaaaaattgagtgtgcgggatacggagaaactggtaaaaagtctccagaatgaaaaaaagaagaaaaaagaagaaaaagagaagattgacccgaaactggaagccgtgtatcatgatttagaagagcagatgaaaggcattcttggaacaaaggtatgtattaaccataaggatgcgaagaaagggaaacttgagattgaatattattcccaggatgaacttgaccggattattgacatgattcggacgatacaaaaataaatgtagaaaaatagggataaaagcctatttaaaattttaacagaatgtaagaaaatagaaacaggagaaaaatatgatatcagaatacttaggatttgattccgattatattattttaggattagcagctttttgtgttattttatttatacttaccgttgtgaatatggcaaagacaagtaaactgcgtaaaaagtatgaagcattcatgatgggaaaagatgcaaaatcattggaagaaactttggtaacccgtttgtctcaggtcgataaactgatatctgcaaatgaagcaaacgagaaaaatatcagaaaaatgtttgacaatatgaaattcacatttcagaaggtcggactggtaaaatacgatgcttttaatgagatgggtggaaagcttagtttttcccttgcaatgttgaatgagtcagataatggattcgttctcaatgcagtacacagcagagagggctgctatacttacataaaagagattatagacggaaattcaattattacattagcagaagaagagcaggaagctttaaagatggcaaaagaatctaccggcagcaatcctgcaaaataatgggagtgtaacatgagggtaaaatcagtaagcgagttgtgtggaaatgaaatattagcagaaccagttcttacagatgaaaaaatgatattaatttcaagaggaagcaggctcaagaaggaatatgttcctttgatccgttcacttgggattgacacccttatggtagaagatccgtatgaaaattatgaaatgccatcgcggattattgattattctgttttcggtaagtttgtggaacgcgtacagcgggtgatggaaaaccatatctatcataagaataagtcactgcgcgaatttgaagtaatcgcaaatgaagttgtaaaagaagtaagcaaaataccggaaaatataattattgatatcaatgcccggattgtaaatttatatgaacatactgtcatggtaacacttgtgagtgtatttgtggcaagattacttcatctggatcaggtgaggcaatataatattgcagttggggcactgctccatgatctcggactccgttatatcacaacaggatatgtgaaccgggactgggaaaaggaagatcccatagaagcatttgagtacaaaaaacataccattttaggatattccgctttggatgaggaaagctggatcccggaagtatcaaaaaagatggttttatttcatcatgaaagacttgatggaagcgggtttccgatgcgccgcagagattttgcaatggaatgcaggattattcaggcatgcgatgcatttgacagttatattacgggcatggagtgcatacggattcccctgcaggatgcaatcggaaagatacaggaaggaatcatacacaagtatgaccggaaagtggtggaaaccctgctatctaagattgcctattatccggtaggaacggtagtgaagatgagtaatcaggcagagggaattgtcgttttgcagacagaggatccgaagtgtccggttgttctggattttcattccggggagtcagaaaaaaaatataatttaatgttacaaaaggatatttccattcttcaaataatatgatagaatgtagtaatgtatggagaaaggagaaccgcgaagtgcacaaattccttagggcgattggattttcagatattacaaaaaaagatcttgaaatgatactggatgaagtaattacccgtccggagattatgaaaattacaaaagattctgagggaaacgagtttgcggaactgtcaggttcatttgcggcaaatgccggaattacggttcggggtacttatcaggaagatgacagttttcatatggattattactatccgtatgtgtttggtaccagtattacgacgaatgagcagattgatgtagaaaaacatgccgagaaagagtcctatgcaggagtatgtgacgaggttaatcttggagttacactgattttttatatacagaatgtagcggattatctggcagagacaaaccgacacctttccaaaatacattatggggcaatgcttgcaggactttccaccgagggaaaaatactctgtcccgttgtggagagaaaaaaaaatgatgtaccggctatccagaaaaatgaccggcataatcagctgatcgcacaggcaagagaaggcgatgaagatgcaatcgaaagccttacgctggaggatatggatacttatgcactgctgtcccagagagtgatgaaggaagatattttcagtatcgtgaagtcaacgtttatgccgtttgggattgagagtgaccagtatacggtattgggagaaatcattgactgtgtcacgatggaaaataaacttacacacgaaaaattgtatggaatgaagttgttgtgcaataacatccagttcgatgtgtgtatcaatgaaaaagatttattgggtgaacctgcgataggcagacgttttcgtggaaatgtctggatgcagggaaacctttgccttgaataaattgtcaggaactgccggtaatcggcatttgttctcttagttaaatggatataacgacagcctcctaaggtttaatcatggttaaacccagtgaaaacacagaggtggtaaatcggagttcgattccaacagggattgatgaagatgttagaataagatataatggaaattcatcacgaaagtgattggattcatagatatggcaaccgtagccaaaaaggtgtgaaagccttgaaaatacggcatttgtctccttagttaaatggatataacggggtcctcctaagactctattgtaggttcgattcctataggagacgctacattttagcggtaatgaagacaaaatcattgccgcttttttcatgcagaattgcaatttcagtgacaaatttgtcagcgaaacagggttaaatatactgattttgtcagcggggatggatgcttgtcactgattcacattttctagtctgtcacccggacggattaactacagtgtaggatgagctttggggtgtaaaattaggaaaagcagtgaaacaaaacacgatattcttgtctgtgatatcaggcctgtcggaagagtccgttcagattagagaaatacaatctattctggacgggcttttttgcgttcagggaaaggaaattgcctatggaagaaaagaaggaattgcagaatcaggatgaaagagttgtagagattgagctggaaagacttcggggatttgtaaaccatccattcaaggttcaggcggacagtcagatgattgaattgcaggagagtattaagaagtatggaatattaaatcctctgatagtcagaccgaggcaggatggaacttatgagatcatatcgggccacagaagaaaatttgcagctgaaaagataggttatcgtaaggtacctgtgatcattcgtgtattaaaagatgacgaagcggttgtatctatggttgattcaaatttacaacgggaaatgattagtccaagcgaaaaagcatttgcttacaaaatgaagtatgaagcaatcaaaaggaaggcaggaagaagaaaatgtggtcaggtagaccataatttgggaaagaaaagcattgagctcattggagaagaatgcggagacagccccaagcaggttcagaggtatatcaaaataacggaacttattcctgaaatgcttgaaaaggtggatgacggaagcatgggatttaccccggcagttcagttgtcatttctgaaaaagaaggagcaaaaggaaatgctggatgcaatggaatttgctcagtgcacaccatcactttcccaggcactccgtataaagaaattaagttcggatgggaaccttacagtaagggatatggaagatatcctaagtgaaattaagcaaaaagagatagaccgcgtagtattcaaaacggagcagcttcacagattttttcctgtcagttacacggcagagcagatgaggcgtgaaattttggaaatgttgaaattaaatatgaacaaatattgggatgcataaaggaggaacggattatgtgcagagtaatagcagtatcaaatcaaaagggtggagtaggtaaaacagtatcatgtgtgaatcttggaattggattggcacaggaaggaaaaaaagtacttctgatagacgctgatccacagggaagtcttacaatcagcctgggatatgaggagccggatgaaatggagtattctcttgcaacactgatgatgaacattgtgaatgatgaaaaactgaatatagaaaagacaatcttacaccataaggaaggcgtggaccttatcccagctaacattgaattatcagcaatagaggtgtctttggtaaatgccatgagcagggaactgattctgagatctatggtagacaggctgagagaattttatgattacatcataatcgattgtatgccttcacttggaatgatgacaattaacgcattagcatgtgcagattccgtactgataccggtgcaggcagcatatcttccggtcaaaggcttacagcagctgatcaagacaataggaagagtaaagaagcagctgaacccaaagctcaagattgaaggaatacttttgacgatggttgataacagaactaattatgccagggatatttccctgatggtgtatgatacatattctgcatcaatcaaggtgtttggaacagagataccgatgtcagtaagggcatcagaggtcagtgtggagggtggaagcatctattcctatgatccaaagggaaaagcggcatttgcttatatggcattaactaaagaagtattgaaggaggcagagtaattatggcaagcagagtagcaggaaagattaaattacagtcagtagatgaattattgggagtaccggagattgccggtactcaggaaatagagattgaaagaattcatgcgtttccgaaccatccgtttaaggtgctggatgatgaaaagatggatactttggttgatagtatcagggaaaatggcatcctgaatccagtaattgtaagacctgatcagagcggaaattatgaaatgatatctggacatcgcaggttacacgcagcaaagattgtgggattgaaaaaggttccggctatagtaaaggaaatgtctgatgatgaagccattataaaaatggtggatgccaatattcagagggaagagatacttccgagtgaaaaggcatttgcatataaaatgaagcttgatgcattgaagagaaccgctggaagacctacaaaagaaaatgcgtgccataatggcacacatttacgatctgatcaagaattagcattacaggtaggcgacagtgcaagaagtattcaaagatatatcaggcttacagaattgattcctgaattattggattatgtagataataagaaaattggactggtaatggcagttgatctttcataccttgatgaacaggtgcagaaatgggtatatgaatattttaaggaaaatggatttttgaagccggtacaggttgaagcattgaagaattatcctaacttatccaatgtaacacaattcagtgtcatttctataatgaatgatgcattaccgaagaagagcaaggaatcaaagctatctttttcagcaaagaaactggataaatattttccaccgcagtattcaacaaaagaacgtgaaagtataatcattcagctattggaacagtggagtgcagatcaggtacagtcagagtagaaatataattatgatgttccagaagtgtagaaacggcacttctggaacaggaaggagattcaaatggaagacagaataagactatcctatttctatggaaaggaagcggatcagttttcattttataaaataccgaagttattatttaccgaagagtatttcaaaaaaatatcagtggaggcaaaggtgttgtacgggctgatgctggataggatgtcactatctatgaaaaatcagtggatggacgatgaagggagagcttacatatattattcgcttgaagatatcatggaggctctgggatgcagtaacaaaaaagcaatatccataatgaaagaattggacacggatgctggtataggtttgattgaaaagaagcgccaggggcagggaaaaccaaccatgatttatctaaaacagtttatggtgcaggatgttcagaagtgtagaaacttcacttctgagcaaaaagcggcagtttcagaagtgaagaatttacatatcttgaagtgtaaaaatgccatgtctagaagtgaagaaattacacttccagaagtgaaaaatattcacactaataagaataatataaataatactgagttaagtaatactgaatcttatcttatcgtatctggaaatgatgagataggatccgacgtacaggcatatgcagaacttatcagagataatattgatctggatattctgttagagagatatccgtttgacaaagagttacttaacggcatctttgatctgattttggaaacagtgttatgcaggaacaatgaaattgtagtggcatccaataaatatccggcagagctggtcagaagtaaatttctgaaactgaccagttcgcatattgaatatgcaatgggatgtatgaaatcaaataccacaaaagtgcataacatcaagaaatatctgctggcaacattgttcaatgcaccaagtacaatcagtggttattatcaggcagaggttaaccatgattatccccagtttgctgtaagtggcaaataatgacttgacgtatacggatttcgtgtatataatcaaattaacaaatagacacggattccgtatatggaggcagatatgagcaattttgaaaattatgattttatattacctgatggagtggtaattgaaaatgaaaaggctgataaagaaggaaggaagaaaagaatgtctgctatgtgtgtaaaggtccgtgaacagacaaatatgaacagaaaagaatttgctgaatggcttggaattccgtatagaacgatgcaagactgggagcggggtgtgagcgaggtccctgattatgtactgaatcttatagcatataaagttaaaaatgaaaaagaaaaaggaaacatttgataattgtatgtaaggcatggaggtatccggttatgtatgaagatgaatattattatgaagcacggaaaaaagaaaatgcaaaattagatgccgaactggcggggacatttgcaaccgtcataggtggattgattggtgcagtgttatcatgcttattatttctgctaaggagatttgatgtattaagctcaggattggcatcattattattctatatgcttacttatacaagagagtggcatgtggctgtctacattacagtggcttttgtaatattcatcgcatcaatgattttacaacatgcgttcttggcaggaagaattatttttacaatctttgtaagtatggcagttgcaataataggtgcaggctggaaagcatatgatacagaaattcagagaaatacagttatggtaatatgttttgcagttactgtgatactaggtctgatatcgtggaaaggaataaaagctaaggaatcttaataactgcgacgaacgactacggtttgactactattttgactctttttttctgaataggggtgtgataatattatcatagacaaatgagacatgaaacgcgagagcggtcaggcatttgtttctcttttgcaaaagaatatggatcaagaatgaagcgtcagctcattaccggatcggtgatgggtatggcgcttttttgatgccaaaatcaggtgacatctgaataataaaatcaggaggaaattgcatggcatatgaatatgaccatgactgtccgtttgaagccttcatcaccaatcttggaaaatacaacgagggtgagctggtcggcgaatgggtgaagtttcccaccacatcagaagaactgcaaaaagtatttgaacgaattggaatcggctcaaaagatgatttcggtaatccttatgaagaatggttcattagtgattatgactgttatgttgatgggctgtatgaaaagctgggagaatatgaaaacctggatgaactcaattatctggcttccaagctcgatgagctggatgatcatgattataaccattttcaggcggcaatgcagatcagtgattatacaggcagcattaaagatgtgatcaatcttattgataacctggataagtatgaaatctatccgggagtagaaagcaatgctgatctgggacattactatatcgaagaactcggtatgatggaagttccggattatcttgctgattacattgattatgaggcctacggcagagatgtggccattaacgaaatgggacagtttacagattatggatatgtgagagatacacaggaatattttacagaatattacgatggagaccgtgagaacatcccggatgaatacagggttatggattttaaggtttctggtgagaaagagaggaaaactatgaattacgaaacatttaagcaggaatttgcagaggatatcaaagaaaagctctatgagagaggctatgatgatgtaaggatcagcttcaataatgtggagaagacaaatcagaattatgaagctatgtcggtcgttccggaaggcagcaatgtgggggttaatttcaatattgagaatgcctttgcaaactatgagcacacggatgattatgccggagtgcttgccagtgcaacaatggtcattgctgatggtcttgacagagcccctgctattgatgtaagtgctcttatggattatgagaacatgaaagagaagctttctgtggaagttatttcagcggatgcaaacgctgatctgcttgccaacgtaccgcatgacagaatggaagatctggcagttgtatatcgttttgtgatggagagcagcgaagatggacgtgcatctattctggtcaccaacaatctgatggatcgtatgggagtttcccatgaacagctcagggcagatgctttggagaattcaccggagatcagaccggtagtgatcatgggaatgaatgaggtcatgaaggaaatgattgacccggaagtatatgagatgtttggaattccggatgatgcggaggaaacgatgtacgtcgcaacagtccctgataagaattccggagcaggagtaattgcctatcaggatttcatggatcaggcagcagaaagagttggcggagatttctttgtgctgccgtcttccatcaatgagatccttttagttcccgataatggagacatgacagctgatgcgctcagggatatggtaaaggatgtgaatgccaaggaggtaagcccggaggaaagactttctgataatgtctaccattacgattccaaggatcatgtctttgaacttgcagagaagtttgaggcaagacagcaggaaaagaaaacggagattgatgaaaaatcagaggagaaaggatccgtattaaaagatctgaaggataagcagaaggaagcagctgcaaagcctccggtaaaggatgctgcggaaaaagcagcaaaatcaaaaggcagagaagtattataaaaaaaggattgtgtcagcctgtggtgattgccatgggactggcacttttttgatgggaaggaatggtgattacagtggcagaagcacataagggtacaaacggacagaagggaaagagttacagcggaattggtggaagaccacctataagtcatccaaaaaattgcagccatgagtgtccgtatggtcatgataaatcgttctgttttccatgctataaaaagctggtggaagacatgagaaagaaaaaggaaacaggaaatggcatttgattatttctatggggcacagtcacagcagtttgcattttaccggattcccaaggtgctgtttacagataaccggttccagaatatttccacagagggaaaggtcctttacggtcttttattggacagggtatctctgtcaatggaaaacggctggattgatgatgagggaagagtgtatatcatttttaccctgacaactataagacaggcaatgaactgtgcagaaaaatcagcaatcaagtatctgacggagctggaagagtttggtctgattgaaaggatccggcaggggtttggcaagccggcactgatctatgtaaagaattttatagaccagcagaatttacaggtcaggaccagtaaaaattacagttcaccaccagtaaaagttacaggtcaggacctgtataatttacagcctaattatacttataacaataatactgattttaataatactaatcctatcttatcagaggatgaggataggatgggatatgagaaatatttcatggaacagctcaatattgaggcattgaaacaggattatccatatgacaaagaaatgatagacggtatcatggagcttattctggatgttgtgtgttccaaaagaaagaccatttgtattgccggggatgtgaagtcagtaaatgtggtaaaggggcggttcatgaagctgaacatggagcatatacgctatgttatgaactgtatgcaggaaaacactaccaagatcaggagcatcaagcagtatatgctgacagcactgtataacgcaccggcaacaatagacagctattatcgtgcagaggttaatcacgatatggcagaaggaaaaatatagcagaggagagacaaagatggatatggagaaaatcatggcatatgttgagaagattgcagaaaacctggaaggactggtttgtgcaatcggatgtgacagtatgccttctgatggggcaatttatgtagacggcgaacagaaggtgaattatatcagtaccagggaagcattaaggatccttgatggatttggaaataacagtgcgtcagtaatgattggaaaatcagattatattctgatctatgacgcaagcaaaaagctggtcattgacggggaggcataccttccgtccgggtatctggtcatgaagtcctgtaatggattacaggcgattgatgatgaggatattgcggatgtgattgcagctttgaaaagcaggatgacaatgcttgcacttggaaaatacagaattcaggcataccagctgggataggaggcggcagatgaataacaaaccgtgggcttatgtaacatctgcctggagtgcagacaggagcagagccaaaaggtctgcaaaacgatattgcagaaaattatatgaagcaggctacacaccaatctgtccgcttttatcattgccggaggtaattgataccagtaatgcagatgagtacaaggattatatggatatgtcagaagatatgttaagaagatccagaattctcgtggtttgtggttcagcggtggatgatacggtgcttacagatatagcaatagccaaccgctttcatgtagcttcatccactatgaggggagtcctcggtgtggataagaataaaaaagaacagtaactttgtggatacagccttcgggctgtttttttgatggaaaggagtgagaaaactggttcatgaagaagttgacagggagattgccaacaaatctgtgaatatagcaatcaaaatgttaaaaccggaacttgatcagcttatgaagggattaagagaggcagtacaagcccctgtgaaggctgctgggaaagcagcagttaataagatccatccaacaaccggcaagcagtcagtgaaaacattgatcaggcagggacagggagtttcttctattcctttagcagatgaaggtctgaaagattttcaaaaaatcgcaaagaaatacggagttgattttgcggttgtaaaagataaagaggcaagtccaccagtatatacggtctttttcaaggcgaaagatacggatgccatcacaaggattttacaggattattctgcaaaacaggtcaagaagccttccgtagagaagaccagtgttctggagaaacttaaaaaattcaaggagattgtggcggcaatcccgaagaaggtagcagagaaaaagaaggagaggtcgcgatgaatacaaaacagttgaaaaagcagctgatcctgaatatcccctatatcattctgggattgcttgcaacaaatcttggtgaggcatggagaattgcagccggagcaaatgcatcggaaaaggttcagagtctggtccttgatggtgtatttgcaacggctttttctaatcctctgccgagcctttatccgggtgatctgctggtgggaattgcctgcggggcagcactcaggcttgcagtatacctgaaaggaaagaacgctaagaagttccggcacaatgaggaatatggttctgccagatggggcagacatgcggatattgagccatttgaggatcctgtgtttgcaaacaatgtgattctgtcacagtctgagaggattaccatgagcagcagaccgaagattccgaaatatgccagaaataagaatgttctggtagttggtggatccggttcaggtaagacacggtttttcataaaaccgaaccttttacagatgcattcatcctatgtggtgacggacccgaagggaggtctggtcaatgaagtgggaaatgccctttataagaacgggtaccggatgaagatatttaataccatcaacttttcaaaatcaatgcactataaccctttcgcctatctccattctgagaaggatattctgaaactggtgacaacgctgatcgccaatacaaaaggggagagcaaaggcggggatgatttctggctcaaagcggagacgctgctttataccgcattgattggatatattcattatgaggcaccggaagaggaacagaatttttcaacactgcttgaaatgatcaatgcaatggaagtccgtgaggatgatgaggaattcaagaatccggtggatatgatgtttgatgaactggcagaacagaatccggatcactttgctgtaagacagtatgccaagtacaagctggcagcaggtgttgtatgctctaaaagacttcttaatcaagcggttgggaagtctcttagaacacacaacctaaaaccgaagaaaggagcgcaagttatgagaaaaaacgagaaaatcactgctctgtacgaacgactgagccgtgatgactttggcaaagatgatgaccaacagcgtgagagcaattccatttccaatcaaaaggctatgttggaggagttcgccgcccggcagggctttacaaacattgtccatttcacggacgatggcattagtggtacttgctttgaccgtcccggatttttagcaatgatgaaagaagtggaagccgggaatgtggagtacctgtgtatcaaggacatgagccgcatggggcgtgactatctgaaagtcggtcagattatggaaatcctgcgtcagcgtggcgttcgccttatcgccatcaatgacggcgtggacagtgccaaaggggacgatgattttacccctttccgcaacattatgaacgagtattacgccagagacaccagccgtaaaatccgttccactttccagtcaaaaggcaagtccggcaagcacctcacaggcacggtcatttacggctatctctggaacgaagccagagaccaatggttggttgaccccgaagccgctgatgtggtcaagcgcatctttgccatgacgattgacggctacggtccgtatcagatcgccagcaaactgaaatcggaaaaggtgcttattccgtctgcttaccttgcccaacacggcgagggcgtgaacaaaaacaagactttcaaagatgtgtacggctggggttcttccaccatctgcaacattcttgaaaagcgtgaatatctgggacacaccatcaatttcaagacccgaaagcacttcaaggacaagaaaagccattatgtcccggaggacgaatggacaattttcgagaatacccatgagcctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcccaatacagcaaagtcccagttggaaagctctgcaagacccagcaccgtatcaatgaagatgtggtactgtcccttgtctctgaaatgctcaaagccattgccgagtatgcgaagcatgaccgagccgagtttgtccgtgtggtgcaggaagcgcagtccagccagcagacagcagaggttaagaaacagcggatacgccttgccaccgcaaagcagagagtgtcggagctggaagtcctgctctgtaaaatctatgaggacaacattttaggaaagctgtccgacagcagatacgccactctggacgctcaatacgaaaaggagcagaccgagcttaccgctgaaatctctgctctggaaaaggcagtcaagagctacgagaagcacgaaaaggacgctgaccgttttatcgctctgattgacaaatacgagaacttcgacaagctgaccattgctatgctcaacgagtttatcgagaaaatccttgtgcatgagcgtgaccgcaaaggcagtatacagaccacacaggaggtcgagatttacttcaattttgtcgggcgatttgttcccccggcgtttggagaagtggagctgaccccggaagaattagaggaaatccgcaaacgtgaggaacgcaaggacaggcttcatcagaactacttgaagcgtaaagccagcggagcgcagaagcgatacgaggacaaaatcaaggggagaaaaaaggcagaaatcgaagccaagaaagccgctattcgtgcggaggatattgcaaagggagtgttcgtccctgtcagcagtttaccgcagagagagccgatgaaaggagtacaaacagcatgaatatcacttatacacagaacggcgattatcttatcccgaacatcgttatccgcaagaccaagcccctcggacactacggcagacttcgcaaggcgtatctggaaatgcaccgtccgatactgttcaatgagctggtgctatccgacaagctctttgagcattgcgccgagattgacgaagcggcacgaaaccgcatggagctgatcgtgcggtcactggcagagcaaaacggcgtgaccgagcaactaaaagccaaaaaccaaatggaatgggtgcggcagatgaacgcttgcaaggcacaggcagaggagattgtgaaagcggaattgatttatgattgagcgaggaagtccgggcagaaaactgttcggacttttctcatgtagtccaaagttgcggtagaattgttcacgagttttatggtataatttatgcgaataaagaaaacggaaaattagaatctaacaagagaatgtggttgtatgaaaaaatccatattagtattttgggcaatcgtgtgtctgttacctattcaaaggaggtttaagaatttcaaatgaaacatataagaaatatattgctgttgattacgattatttttgcttttgttatgcaagctgaagtatatcaaaatatgctctggaactttaatggtgcttattatttatcgtccagatacacaactactaatgacgatatggattcatttttagccaatgcagaagatacagctgagaagcatggtgttcatattttttcgacttttaatcagagagtttctaattatcagacaagactttatatttatggtgatgataccgttgttcgggatagtcttaaaagcacaatggatattgaggaaaaaacatatacggctttgataggtggaatcaccgtaatagaatttgaagattttagagaagcaaaaaacacaggcaatggacaggaaataatggtcagctatatcggtgatgatgatgacattattgccacatatcaagatttggcaaaagaatattctatatcgcagccagagttttggcaatcaaccgaaactgatatgatgttcattgtttggggcctggttgccatattgatgattgtacttaatatgattgaggtgatacgcaggcaaaaggaagtagttgtacgagcttctctgggcgaaaatgctgctgtgattgctctaaaagctgtagtggctgatatgatttcatatgctgcattattcgtcttagcaaagttgcttgtttctcaatttatatcgggagcgtatgaagatcatctcattttggcagtgtattgtgccggagcagttctttccgtaattccttatgctgcttttgtccgctttgatgtaaaaaaagcctttgccaatgcttcagataaaaaaggtatgttttatcttctgaacggtcttaaagtatttgctactgccatgacaatttttacaataactacaaatctcagtagcattcaaggtaatttacttacaaacactactcttttagaaaatcattataatgattattattttggagttatgcagattgaacctccttttgaagaaaatgaggaggaatccaaagagagcaaattttggaatgacctttacgaaaatgaatacaacacgataaatccggtggtctgcataggcagccggataagcgatacggataattatatttttgtaaatcataatgccagagatatgctacaagggttttctgatatgcttactgaagatgatgaaaaagaggatatcgtggtcttcgtgccaaagggaagaaatgcggaatcatacaaagatatcgcaaaagaggaaattggctctcttacccaaaatgcagaagaactgcgtgttgtttataaagaatattctggcagagaacaattttattatctcaattcgaacagagaagaggctattgacggattgtcaagagtaacaaatccgattgtgatttatcaggcaaatgaggctgttgctttaaatggaagttatatcgaaacaggaacatataatggtgaggtaatctacggatgcgatgaaagcacaattcgcagtgttgcgaaaaaatattcagaacagcttggttcacactattttatgctgacgaatgtcggagaggattacatttatagtcatagtttcctcgtgaaactgattggctttataagctctctttgcgtattagtattgctgttagatatcgctatcatcatatctgaagtgaaaatggaatttagacttaatgcgatggaaatctccctcaaaaaggttttgggctatcgcttttatgaaaggcacaaaagatttatttccgttaatctcttagaaaatatagccgttgtgatattgatttgcattgtttcgatttttatatctaacgcaagtgtcgggattgctttactgattggagcgttgctcaccattattgaaatggcaatcattttcacaaatattatgtgggttgaaaaaacaaatatctcaaagtcattgaagggaggatgtttatgattataattcgtggcttaaataaagcatttggagagaaaataattttctctaactttaatttagaaattccggatggaagttttgtagtaatcagcggcgatagcggcagtggaaaaagcactttactcaatatgattggtggtatcgaaaaaccggatagcggcagtatcataatcgaagggctgaatattacccggcttaaaaataaaaacagtttttttgcggatacagtggggtttctttttcagaattttgcactgcttgaaaataagacagttaaagaaaatttaagtttgattaaaaaatcaagccgaactaaagtatcacttaaagaagctcttaatcgtgtggggttatcaaaggaagttaacaaaaaagtttatcagctttccggtggtgaacaacagagagttgctttagctcgtcttatgatgaaaaaatgttctgttgttttggcagatgaacctactggctcacttgacaagaaaaatagagatattgttatgaggttattgcacgaactcaatgaagaaggtaaaacggttatcattgttacccacgatcagggtattattgaagatgaaccttatgttgtgaaaatctgagagtacctcttagaaatgtcttgatctacattttatataatttgggtcagaagaaaatccctttaggaactaaagggcgcacttctatactctcctatcgggagtatgtgcgtcctgcggagcttcattctctgtcagcagaagaaaactgcccgaccgagaaagttgcgtcacttcgttccgtcaaggtggctacacccccttgcgccgctaatgcggctatcccctgtggacttgccgtccgcaaacagcataaaatgctgttcgccgccagcaagtttggaaaaataaataccgaaaatcagaccgttgactggtcgcactatgcgaaaagttgacggtctttttttatccccaaaatcaaaaaaggaggtcaatcacaatgacaaaaccgaaaacccttgaccagctccgagccgaaaaggaacgagccgagacgcagcttgcacaggaacaacacaagctggagcgtctggagaatagaaagaagtatctggagaaaggcgaacgcaccaagcgcacccaccgcctttgcaatctgggcggcacgattgagagccttgccccggaggtcaaagatctcacacgcaccgaaatgacagagctgatggaacacatcttttccctgtccgaagtccagcgagccgtccgtcacatggcgattactcatatcagccaagcaaacagagaaaaggagttgaaagccgatggcactatttcatctgagcgtcacgcagactaagcgaagcgcaggacagtccgctatcgcttctgccgcctaccgagccggggagcgattgtatagcgagtattacggcgaatacagcgactacacccgcaagggcggcgtgatctgctctgacattctcctgccgtcccatgcaccgcccgaatacgcagaccgccagaccctatggaacgccgtggaaaaagccgagcgtggaaagaacgcccagcttgcatacagctttgacattgccttgcagaatgaattttcccttgaggaaaacatcgctcttgcaaggcaatttctgttggagaactttgtgagccggggcatggtggttgacttcgccgtacaccagcccgaccgggaggacggaggcataccaaacccgcattttcatgtgctttgccccatccgtcccattgagcagaacggcaaatggggactaaagcaacgccgggtgtatgaggtggacgaggacggcaaccgtatccgagaccagaacggcgagtttattttcaacgccgttcccactaccgactggggcagtcccgaaacgctggaatactggcggcagacatgggcggagctatgcaatggcaagtttgcggaaaaggggcttgatgttcgtatcgaccaccgaagctatgagcgtcagggcgtggagcttcttcccaccgttcatgagggcgcaaccgtccgggcaatggagaagaaaggtatccgcaccgagaaaggcgagttcaaccgctggatcagagcaaccaatgccgttatccgggacatcaagaagaaaatcgctctcctgtttgattggattgccgaagcaaaagcggagcttgccaagccgcaggcacccgaccttgtttctctgctgaacgcctattacacccagcgcagagccggggcatattcgcagaaaggcaaggtcagcaacctaaaggagatgaacgagactttcaattatctccgggcaaacggcatttactcccttgaagatttggaacaccgtgtcagcgaacacagtgctgccacagagagcttgaagaaaacgctggacgaacagaccgcccgaatgaaagcaattaagcagctctatgacagctccgctgctttccagagcttgaagcctgtctatgacggcttgcagaaaatcaagtttgagaagcccagagccaagtacaaggcagagcatgaagcgaaactgaaacagttctacgccgccagacgcaagctgaccggagagttcccggacggcaaggtggatatgaaaaagctgaccgaagagtatgacgagctggaacaggcgcacgaaaccacctatggcgagtttaagaccgtcagagacgatttacaccgtctttggaaggtcaagtcatgtgtagatactgccgcccgatttaacgagcgtacagaggaacaactgcaccaaaatcgaccccaaacacgacacaaaaaggaggaactatcccgatgaattacacccaagcacagattgaccgggcgaacgccgtcagtctggaagattttctccgcacacagggagagacacttatcaaaagcggacgggaataccgctggaaagaacatgacagcctgaccgtccggggaaacaaatggtttcgccacagccagagcaagggcggctatcccattgattttgtcatggagttttacggcaagtcctttcccgaagcagtccagctcttaaccggcgaaagcgccgagggacagagcgaagccagcacagcaccgcccacagcgtttcacttgcccttgcacaacagaacagccgacagagcaattcaatatctttgcgaaagccgaggtctcaacaaaacgcttgttgaggcttttcttctttccggggatatttacgaggacgcaaagcggcacaatgttgtgtttgtcggcagagaccgaagcggtacgccgagatacgcccatgtgcgaggaacggcagacccattcagacaggacattgccgggtctgacaaatcctatccgttccactatgagggaaacggcaaccagctctttgtctttgaagcaccgattgaccttttgtcctttatctgcctttatccgcaggactggcagacaaggagctaccttgccctgggcggcgtttcaggcaaagcccttgaccgttttctttctgaacgcaaggacacccgaaaagtgttcctctgccttgacagcgacaccgcaggaagtgaagcctgcacccggctggcacaggacattcccggcgagatcgccgtcattcgccttgtcccggcaaggaaagactggaacgatgttctccgtcagcaaggggacattcccagccgcaaattcatagccgagacaatcacgctgcgagagctgcccaccgcccagcctgttcccatgctccgcatggcagatgtggagctgacgagcgtggattggctatggtttccctatatcccctttggaaagctgacgattatacagggcaaccccggcgagggcaagacctactttgccatgcgtcttgcggcggcttgcaccaaccgaaagcctttacccggtatggagacccttgagcctttcaacatcatctaccagaccgcagaggacggtctgggcgataccgtcaagccccgactgatggaagcggaagcagaccttgaaagagtgcttgtcattgacgatagggacacaccgctgacccttgccgatgagcgcatagcaagggcaatccgggaaaacaacgcaaggctggttatcattgacccggtacaggcgtttctgggcgcagatgtggacatgaacagagcaaacgaggtgcgcccgatattccgcagtctgggagacattgcacaggctaccgagtgcgctatcgtgctgattggacacctgaacaaagccgcaggaacgcaaagcacctaccggggattggggtctatcgacattacggcggcagtccgcagtctgctttttatcggcaagctgaaggacagccctacaacgagggtgcttatccatgagaaaagctcccttgcgccgcccggacagtcccttgcattttctctgggagacgagaaaggctttgagtggataggggcttatgacattaccgctgacgagcttcttaccgggacagacaccgccaagacggaaagtaagaccgcacaggcagaaatgctgatactggaactgctggcagacggaaagaaaatgccgagtgcagagctggaaaaagcggtcaatgacaggggcatatcctcacgcacgatgaggacagctaaaagccgtattggagacaggcttgtgaccgagaaagacggcacagcatgggtctgctatctccgaagctgacgcaggaacacggcaagcatggcaaagacggcaaggtttttatagataccttaatgttgccgccttgccttgttccctcataccgacaccgcccgatgatgaacagtcaccgggcatttttcatttacaggaggattttgaatgaacaataccgcaaccaacagcaccccttgcccgactgtcagaaagcagatcggcaagacaacctatatcgtccgtgtccatttcagccagaccgccaaagagacgatggaggacaaaatcaagcgtatgcttcgtgaggaagtccgcaaaatgtgacttctttgtgaatttgatgaaaaagtccttgacttttcgtctctggaaagacggccaagtccattctggtaagctgtggtgcaagactggcaccgtttgatatcaaggaactcagagacctgacagcttatgatgaactggagcttgatactctgggagatgagaagacagcactgttcctgatcatgtcagatacagatggaacctttaacttcctgatttccatgatctatacacagatgttcaatcttctgtgtgagaaagcggatgatgtgtatggtggaagattaccggtacatgtaagatgtctgatcgacgaggcggcgaatatcggccagataccgaacctggagaagctggttgcaacaatccgaagccgagaaatatcagcatgcctggtattacaggccaagtcgcagctgaaagcgatttataaggataacgctgatacgatcatcggcaacatggattcacagatttttcttggtggtacggaacagaccactttgaaggatctgaatgcgattctgggaaaagagacaatcgatatgtataatacaggtcagtctaaaggatcccaggaaagctacaacatgaattaccagaaacttggtaaggatcttatgacaatggatgaactggcggtcatggacggctcaaaatgtattgtgcaggtccgtggtgtaagacctttcttatccgataaatatgatctgacgcagcatccgaattacaagctgacagcagattatgataagaggaattactttgatgtagtaaaattcctcagccacaacttaatactgaaagcagatgacgaataccaggtcatcgatgtaaccgagtaaagagctctttccatccggcgataaaggccgggaggcaggagcttttactatattcccgaataggaaataaaagaatttccagatggggagcaaatatgcgcgcatagccgggatcactgcagggagaccggcagtaactataaaccgccctttggtcagggcagaaggaaaaagtatatcacacataaatcatttaatggaggaatttgaattatggcattttttacaagcgcagtaggaaccttacagacacttgttatcgctcttggagccggacttggaatctggggagcgattaaccttatggaaggctacggaaacgataatcccggagcgaagtcccagggaatgaagcagcttatggcaggaggcggtgtagcccttatcggtaccacacttgtgccgttgctttcaggtcttttctaagagccagcgtggcaggatcacgcaggaagacaactgaatatggataggacacaggaccggaggcataagtgctttccggttctttgaatgtccggaagaaactttaatcaaattcggcagaaaagaataacagccgaaaatcatgaaaattatggagcaatctggtgatatgtcaagatgatttttgaaaagatttcgatatgtttttatctataagcaaaaggacgcatgaaaaaactttcgttttttcacacgcccttttgctgtcctctcggtcccatcctttattttgcattttttcttttcagttctgcaagttcatcgaaaaccacgtcattgacaacctttatgtaagttcctttcatgccggaagaacgcgattcgatcacgcccgcactctcaaacttacgaagtgcatttacaatcacggaacgggtaattcccacgcgatccgcaattctgcttgcaacaagaattccctcattgccatccagttcatcaaagatgtgggtgattgcctcaagttccgagaaagaaagtgtgctgatcgcagattttacgattgcaacctttctcgcttcctctgcgctctcctcgtttacagaacgcatcatttccagccctaccaccgttgttccgtactctgtcagaataatgtcatcaatgtcatattccgtttcgcaccggtattcaaataaggttcccagccgctccccggcaatatcaatcggggtaatgatggcccggtactttttggattcatctccgaatccgagcgtttccagatttacattctcttttgtggaaaggattcccagaagacgctcattgagttctgcatcaatatatccgccgacttcatccacgatcagttcctgcagttcctcaacccctttgcatacactggaacctaaaacctttcccttcttgcttattacaaggatgttggaatcaagaattcccgtcaggacttcacagatatcgttaaataccaccttggacgaattattgttatgaagcagtttatttatttttcttgtcttgtctagaagttgaacactcatgtttttcctcctgtctttatcacagatatcatgagtgtagcactatttatcagacaattcaatattttttaaaaaatttacgactattctgtttctttttcttttgcttccgtgtaaccgcaatgttcatccgcacatgcaagcttgtttcctttttctaccatatagcctccacagcgcggacatttcttttccaccggacgcccccagctcatgaaatcacattccggataatcaatgcatccatagtatcttctgcccttacgtgtcattttgatgaccacgtcttttccgcatttcggacatgcgacaccaatcttttcataatatggcttggtattccggcactccgggaatcccggacatgccagaaactttccatgcggtccatacttgattaccatattgcgcccgcatacttcacagatttcatccgttacttcatcttcaatggtaatcttttcgagatctttttccgcggcctccacagcctcttccagatccggataaaaattcgcaacaaccgttttccagtttaaatgtccttccgcaacactgtctaaaagagattccatatttgcagtaaaatgttcgtctacaatagtcgggaaagattccttcataatggaattaacaacggaaccgatctctgtcacataaaggttcttattttcctttgtgatataacgtctggcaatgatcgttgtgatggtcggggaataggtgcttgggcgtccgattccgagttcttcgagtgtttttaccagcgaagcttccgtataatgtgccggtggctgtgtaaaatgctgcttcggatcgaattcttccagtttcagttttgtatctttatcaattgattttaaaagtacctgtttttcctgcttttcgtcatccgcttccgtataggccagcataaatccgtcaaaagctactttggaagtagaaacgcggaatgtataatctcccgccgcaatgttaacggttgttgtctcatactttgcgtttgccatacggcttgcggcaaagcgtttccagatcagctggtataaacggaactgatcccggcttaacgactctttaatctcggacggaatacggttaatatcggtcggacggatcgcttcgtgcgcatcctgaatctttgcattgctcttcttgcttccttctccgtcagacagatattcctctccgtagctttcggaaataaaggcacgcgctgcttcatccgcctcttccgaaatacgaacggaatccgtacgcagataggtgatgataccgaccgttccctgtcctttaatatccacaccttcatacagctgctgtgcaatccgcatcgtcttcgagatcgggaaattcagcgctttggaagcttcctgctgcaaagtactggttgtaaacggaagcggcgctttttttgtgcgctctccctttttcatatcgcagactttaaattctttgccttttaattccgcaagcacctgattcatctgttcctcggaagaaatctcaaacttttcgccgcctttgtccagcagctttgctgtaatcggttttttctcaccttccggcaggaggcttgcctctaaagaccagtactcctccggaataaatgcatcaatttcttcctcacggtcacacacaatccgtaaagcaacggattgtacacgaccggcactcagccctctttttacttttgcccataacaacgggctgatccggtaaccaaccatacggtccagcatacgtctcgcctgctgtgcatcaaccagatccatatcaatctcacgcggtgtctttaaggatgcttttaccgctgtttttgtaatttcgttaaaactgattctgctgacatctttgtcgtccagtttcaacgccttggttaaatgccaggaaattgcctctccttcacggtccgggtcagttgcgagataaattttatccgctttctttacttcttttcttaactttgcaagaatctctccctttccacgaatcgtaatatatttcggttcaaaatcattttccggagaaaatccgagctgactcttcggaagatctctcacatgcccgttacttgccatgacctcataattttttcccagaaattttttaatcgtcttcacctttgccggtgactccacgattaccagatactttgccatttggtgctccttatatcatttaaattgtttttatataataattcggaatggtctcctgaatgaaccctttctgttccagcctctctaaaaccggcagaatttctgccagaccatagggacttttttcgatcagggttccaagacccaccggataaaaatctaataaagcatacaccaacgattcgtctttttcaagaagattttttctaaagtctatttgtgtcgttatattttggggctgtaattgcagttcctgcaggaaatcttccacacttacaaaaatgccggcgccctgctggatcagatggttggttccttcactcagggcatccgtaactctcccgggaagggcatacacttccttgccctgttccatggcatagtccgcagtaatcagcgatccgctcttttttcttgcctccatcacaatcacgtaatccgcaagtccggctatgatacggtttctttgcggaaaatatcccggcagcggcggtgtgcccggcggatattccgacaaaatgcctccccgatcctgcattttttcatataaataccggtttcttttcggataacacacgtccacgccacagcccagtaccgcataggtatccccgttttcttccagtgctccgctatgcgcatcagcatcaatccccatcgccatgccgctgatgatatccatccggttctgtgcaagtgccctcgccagtttccctgtaatctggcttccataggcacttcttgtccgcgccccgacaatagccacactctttcgtgtttcttccggcagcctgccaatataatacagcgcataaggtgttgcagaaatccggcggagcttttgcgggtaccgtgcttcttccacgcagacaaaaccgattccttcctcctgcagttttccccagcgctcctgtacctcccagtgccgcctggattgtgtgattttttccacatccttttcatccagaacccggatttttttcatttgggactcctgcaaggcatacagttcttccgcaccgatcccttctgtcataagccccgtcagtttatgtacggtcagtccggtatttgcaagccagtacgcatacatgctcatctttccatacctccccagaatttatccccgatactccggtaacacacagcttctgtcagatcacagacacggatgttttccgccttttgtgtatcggcaattgttcgtgccacccggaggattttatgataggtgcgcgcagtaagtgacagtttatgaaacattttttccatataccgctgctccttttctcccagccggcagaactggtttaattttgcggccggaattccactgttgtgagaaaaattttcgtctttgaatcggaaaatctggcgttcctgacactcacacacccggtcccggatggtctttgaactctcattattaccgtttcccgtcagttcttcatacgtaaccatcggcgcttccacacaaagatccatgcggtcaatgagcggctgggaaatccggtcaaaataccgctgcagggatgcctgtgtgcatctgcaccgattccggtccggataatatccgcaattgcatggattcatagatgccagaagtaaaaaatccgatggataggtcacactgccgaccgcgcgcgtcaaatgaatctgatgttcctccaacggctgacgcagcacttccaacgttgatttggaaaattccgggagttcatccagaaaaagcacgccatgatgtgccagtgaaatctctcccggccggatacttcgtccaccgccggcaagccctgccatgctgaccgtatgatgcggactgcgaaacggccgttcctgcaacagtgtccgggagtctgccagcagaccgcagacactgtatatttttgaaacctccagctgctctttttttgtaagtggcggcaggattgtagccattcgctcggagatcatggtttttccggctcccggcggcccgaccataagcatattgtgcattccggacgctgcgatttccgctgcccgtttcaaaaactgctgcccatttacttcggaaaaatccggcatcccatgggatctgttctgccgctggcctgcatatgccggctctttataaccgccatcctgcagatagccgatcaccgattccaatgcagaaaatccgcagacatccgccccctgcaccagacggctttccataagattatccgccggaacaacaaatttatgaatcccttcctttactccatccgaaaccatcggcagaattccccggaccggcagtaactgtccacttaaattcaactccccggaaaaaatcgtgtccgcgcacttctccggttttaccagccccatggcaaccagcagtgcaaccgcaatcggcaggtcaaatccggttccggttttccttatatttgccggagaaagatttacggtaatccgctttgcaggcagaagaattccacaattgtgaagcgccgtacgcactcgttccttcgcctcccgcacctccggagaaagatatcctaccatatcaaacaccggcattcccatgctgatatccacctctacctgtaccggcattgcgcagattccatccagcatggatgtcctgatttggctatacatattcacctcattccaacaaatgggaattttgcacagacacatgcatgaaaaaagatgcatttaccttatcataaaatgcatctttttgcaacgactttattcgcttatcacttttttaagtttttccagtgctctcttttcaatcctggaaacataggaacgggaaattccaagtgcccgcgcgatttctctctgggtcagttcctgatttcctccgattccatatcttcgccgaatgataaatgcttctctctcgcttaacacatcattcataaaggtacagatttttttcatctgctccctttttgtcacttcatctgctacatttttatcatgaaactccagcacatcgacaagctgaatctggtttccttctttgtctgtaccaatcggttcaaacatagaaacttctttgcgctgttttttctttgatcgcagatgcatcagcaattcattgtccacacaccggatggcatacgttgcaaatttatttccgtattccggccggaaactgtctactgctttcatcagtccgatcgtaccgatggaaatcagatcctcctgttcttcttccgaactgatatatttttttgcgacatgggctaccaggcgcatgttgtgcaacaccagttcttcctttgccccttgctcgccattttttaatctgcacagacagtctgtttcctcttccggtgtcaggggaaccaaaaatgttttcacacagcaccttttccaacagctttctaatattctatgtcagcagaaggcattctgtgcttttcccttttatattttttcttccggtgccagttcctgtatgcgccggatcaggctttccctctcataaggaacgtttcctttcagtacctcattctttacaaatgcaaatgtttccttctccccccgcactgccagcatcagtaaaagatagtggatcagtgcctcggtatccggatggatcagataatgcgatctgccgtgcatatagtaatcgagtgcactccggttcgtgtatttgtctttctggtagtttttggatgcactgatcctgtcaacaaacatttccgccacgtagcacaccggcattttcattcctgccatccccgaatgttctttccccggttcttttgaaatatcataatcaatccagtactcgagatggtgtttattgcgtcctttgtgatgcagccacgccagggaataccccttttccttccgctctgcattgttcggactcatggttccctgataatatttgcaaccgaccagaaattccgtcggagaatattttgaaagatcatgcagcaacccctgcctgtatagtccgatcttaaagcaaccgacaagcaccagatttttgtgatgtgtaattgtgcaaaaatgtttccatgcattacccatgttttttcatctccctgctctccagcacacagatggtctgtggccggagaatgatttttcctccgcttacgggctttggtgcgtccaaaaacgcagcatcctcttctccgctgtcaatacagacaacccattctttcccttttcgcggtttaggcaaagccagttccgttgccgcggcaagaaaattataggcgacatagacatccggctctttttcgttttgggcataagccccgcaataaagcattcccaggcatagatgatccggtgtcggttctaacatccacgcacttgtcccgtgataggaaagatccggataccccagcgatttataatccgaaaactggaatggcatcggatttgaaagcacggtatgttcttttcgaaacgcaattacctgctgcagaaattcgatctgtctgcgatgagacttctcattcttccagttcacccagccggtgggattatcctgacagtatgcattattatttccgttctgggaatttcccatctcatcaccgctccacaacagaggaacgccctgtgccagcataagcataagaaccgcatttctccagtttaatttccgcagcgcattgatataacgctttctggtcggaccctccacgccgtaattattgctgaagttccaggaactcccatcgagattctgctctccgttttcctcattgtgcttatcgttgtacataaacagatctgcaagcgtaaacccgttgttgcttgctatataattgatatagcctaaaaaagccccctgttttctctgctgatcggcaaaatcacgcatatttccattgatatgatttaagacctgccggatcggatactgatactcctctttgtaaatatacagattcggatacttccggcttgccgcacatgctttttcctcaaaatccacataaaaaatcttggtacggctgagcattccatcctgcacgatcgctgtaatgggcagatgttctccaagcagatggattccgtccacatggtattcccgcacccagtaacgaagcgcttctaaaatcagattatgattcactttctccggaaaatacatctccatcacacattccatgccgttttcgtgcagacggcggatcagcatcctgaattcccgggaagcatgcagcggatcggcagcatacgatgccttcaccgcaaaataatttccgggttcatatccccagtaattcactttgcgcggaaccttttttattttttctgccgggcggatctgatccgtctgtttttctttccaacggatatattccggaagtttctgctgcttcggcagttcaatttcctcaaactcatataccggcataagttcaactgttgtcacaccgagtttcttcagatagggaatccggttcataagcgcacgaaatgtccccggaacacttctggtaccggaatccatcgtaaaaccacgcacatgcagcttgtacataatcatctgttctctcggtatttccggacatacatcctccccccagtcaaactcctgcacatcaaatgccccatgcacctcatactgctgcaggctgcgtgaactgtcattccagacctgccgccccatgatggcgtgtgcgcacgggtccattaccttttttccattgatcttaaaatcgtaaatcagatgttcgagatgcagatctgccactgcgatagagcgcaccgatcccatgcagtattctgccggaacagctatcttttcttctttttcggtctgtatatccttaagtaccacaaaacagctgtcctctttttccgcatcaaacgtaaaagtggtccattctccctgaatcgtcactcccggttttgcgtaatccccttctctgatccttttattctctgttcgttttttcgtatctcgtattttcatgtttttcattataccctttttaaaaaactttgtatatcactttttcgaattgacaagctccttactcctcgcttataatgataaaagacacaaaaaacgattaagaaaagaggtatcttatggaagataaagaaaaagcaacacccgttaccccggatgagattgaagatatccgtgtaacacttgagctggatgaaggtgaagtagaatgcaaaatccttaccatttttgacgtaaatgaacaggactacattgcactgatgccgctcaatccagacggctctgatccggacgaaggcaccgtttatctctaccgctacgcagaggatgaagaaggtcttccacagatcgacagcatcacggatgacgatgagtacgaagctgctgccgaccgcttcgatgaaatgctcgatgatgactacttcaatgcactcgaagacgaggaataacttttataaaaacctgcatcgcgaatacccgatgcaggttttttacggctctttaccggcttctttgataaaacgcgacagttccacctctttgccacgcattttttttaccgaacagatggtcagggattcctttgctctggtcattcccacataaaacaaacgccgttcttcctcgacatcctgctttaatactgctttcttataaggcattacgccctcgttgacgtcaatcagatacacttttgtaaattccagccccttggcgctgtgcagtgttgcaaatgtcacagcattctgattcctgcgcttttcctgcgccagtctctttaactcctgccggtattcttctatatgtgcaaaccattcctcaaatgtacggtaccctttggcactcgcaaggatttcatctgccacttcataaaaatcttctttattcgcattccggtattcggcatactctgccagataatcatcgtacccgattccccgccggatatagttgattgccgcataagggctcagacgggacaaatgtttcagatcataccacagcttttcgatccgctccgcgatccacggctgctcctcgtataatttcatccactcatcaaaacataccgtttcatcgggcaggctgtccctgccgatataccgcttcggccggttcataatagaaaggaaatcggccctgctgtcacttccctgtgcgatgcggatataagtgaaaaaatcacgggcaatccagtgctcatagatatccggaatccggtctttcgtctgaaatgccagattggcagaaaccatatattccatcagggcacgcggctgcatgtttgtccgaaacagtactgcgatttccgaaagcggaaccccattttgcacagtctgccggatatcttctgccaaaaatgcattctctttatagcagtcctcaaagtactgaaaacgcaccttctgtttcccggattttccggcacggatctttttcggaaaacgttcttcattgtgtgcgatcaggcgcatagctgcctccacaatcggcggctcacaccggtaatttacttcaagattcacaatctttgcctgcgggtatatcttttgaaatcccagcataatttccggcttcgaaccgcggaaccgatagatggactggtcatcatctcccactacaaagagattattttccggtgcggcaagcatacacatgatcttccactggatcagattgatatcctgaaattcgtcgatcagaatataacggtactttttctgccatgccgaaagaatatccttccgctgggaaaacaactcatatgtgtatgtcagcatatcatcaaaatcaatcaggcggtttcttttgagccgctcatcatattcccggtaaatcttccggaaaatctcctccccacagctggaagaataaaaatgttccagcggaatctgctcatttttcacacggctgatctccgttaaaacatccccgataaattccccttcatcccggtattccagatgatgataagacagaatctcccgcataaactgatatcgctgctcctccgatataatatttccggaatcaaaatgatacgccagcttcagcaccatgaaaaatatggcgtggaacgtaccgaaggtcactttcgttctctcttctcctgtcaatgcaagaaaacgctgcttcatctcctgtgccgccgctcgcgtaaatgtaatcacaagaatattggacggatctatgttctcatattcaattaactgtttcgttctttgggtaattaccgcagttttcccggaaccgggacctgccagaacaagcatcgggccatccttatggcggatggcctgctgctgggatttattatagttcattcgttctcccgtgagaatgttctactgtgcctgagaaaggagctcgattcctttacggatacgggcaagagactcttcttttccaagaacctccataagctcggtggcaccgcccggtgtcatctgcttgccggatactgccgtacggatcggccacataacatatccgttcttgcagcctttctgctctacatacttaagaagtgtctgatacaatgcatcgttgctgtaatcttcctgagcctctaagaccggaaggatctcctgcaacacttcaagagaagtctgtgcatttgtcttcattttcttgtgcgtgtacattgccacatcatattccggaagttcctcaaagaaatcaatgtgatccctgatatccgggaagatctcgatacgggtctgtaccatatgtgcaatcttcttcagatcataatctttggtgatcacttctttgatatacggaagtgccatctcgtagaacttgtcaaagtccatttttttgatgtattccccgttcatccattttaacttggtatagtcaaagactgccggtgatttattcatatgatggtaatcaaacttttctaccagttcttcgagtgtcatgatctcctggttatctgccgggctccatccaagcaatgcaacaaagttcacgatcgcctctgtcagaaatccctgctctaccagatcttcaaacgacgaatgtccgcatcgttttgacagcttctgatgattttcatccgtaatcagcggacaatggatatatactggtacttcccagccaaatgcctcatacagacgattgtacttcggggaagaggaaagatactcgtttccacggacaacatgggtaattcccatcagatgatcgtctaccacatttgcaaaattgtaagtcggatatccatcggacttgatcagaatcatatcgtccagctccgcattgtcaacggtaatatccccgtaaatctcatcctcgaacgttgtcgttccctccgtcgggttattctggcggatgacatacggtacgcctgcggcaagtttttcttctacttcttccttggaaagatgcagacagtgcttgtcatatacatgaatttcttttcctgcaactacttttttgagtccctctaagcgttccttgtcacagaaacaataataggcctcgcctttatcgatcagctctttggcatattttaaataaatgccctgtgcctgacgctcactctgtacatatggtccacagccgccatccttgtccggtccctcgtcatggatcaggcctgttttctgcagggttcggtaaataatatctacagcgccttccacataacgctcctgatcggtatcttctattcttaagatgaaatctccgccctcatgctttgctacgaggtatgcatacaatgccgtacgaagatttcccacatgcattcttcctgtcggacttggtgcaaatcttgttcttactttactcattgcgtttctctccttattctgtcatgtgttctattatataacaaatacacacataacgcaaacgaaacatatcatacagtatatgctgatcagaaaggaaaaagaaatccatgaatgcaactattaatactatgccggaaacagacaatggcagccatcaggtacctggcatgtgctacgttccctggcagacattcggcaaaacctacgatcccatgcgcgggcttgccgcaggcacaatttttccggaactggataaaccgtttaccggaaaatgcaatatgaatataatgcagggagggcgacggcgatgacaagaccatcttctcagccaatgaaccggtcggaattgtaccgctgggttatggcactgggcttttgtgcctatgatatgcttctttatctggacacccatccggatgacgcacaggcactctcttattacaatcagtgcaacgaattatacaattcagctaaaaagacatacgaggaacgtttcgaaccgttgtccgcatttggcagccagccgctggaggactgggactggaatgacggtccaatgccatgggaaggagtgaaataagctatgtggaattatgaaaaaagactgcaatatccgatttccatttcaacaccaaacgctaagatggcatcttttattataagtcagtacggtggtcccgatggcgaaatgggagcttccatgcgctatctggcccagcggttttcttttgcaaatccgcggattgccggtgtacttactgacatcggaaccgaggaacttgctcacctcgaaatgattggtgcgattgttcgtcagctgacgcgcggactttccgccaaagaactggaagcttccggatttgcaccatattatattgatcacaccgcaggtgtctggccgcaggctgcgggtggagttccattttccgctaccgaatttcagtcaagtggtgatgccattgctgatctggtggaagatatggcagcagaacaaaaagcaagaaaaacgtatgacaatatactgcgtctggcaaaagatcaggaagttgctgatccgatccgctttttgcgcgagcgtgaaattgtgcatttccagcgttttggcgaggctcttcgtctgctgcaggaagaactagacagcaaaaactactatgctttcaatcccaattttgactgtatgcaaaacactacacgataggacaggagatagccgcccctttcacaccgggcggctatctcaaaagaaaacgcaataaatcactattatttttacttaaataccggattcatcgcctcaatcttgcggatgatctgctccagctgataagcattgtttccgagcttgctcatatttttgagagcctcacccttcatctcatggatacttcccacactgtactccatacgtgcccgcagtttctgccgccttgtcagcagttcatgcttcagctctaccatctcccggctgtcgaccagcgcatttgcatgtgtcagccatacacgggtatcatacatccgcagccgtgtcagatactgcagaagattctgcgtataataatccagatcatcactggttttacggaatgtttccttttcccgcgcttcctcctgatactgtccatataaaaattccagttctttcgcattgcggacatgatatttttcacagatgaaatccaccgcgtttttcgtattgacatagcggatctttacccggttctccaaagtaatcgcctgattgcggttgacatccgcctgacggatctctcttgtggaatcctgataacggatcaaaataaacgcgcccgctcccacagctgcaaatcccataatggtgaaaactagctgcagatccctgttcagataccaggaaagtattcccacaaaagcaaacaacgtaataaacacagctaacagatagcatgctgcggtacgggttactttctgtacctttgcggaatctgaccgctgcatggaccattccagtttttttccttccagatatgccatatttctcttgatcgcatccagatctgcctcattggctttcagccggcggatcactcccggaagattctcttcttcctcctgcatctgcgcaaactgcgtatctgtcagccggcgtttggttttcaggaaatcggttctttgcttttccagctttgcaacctgtgtggcgcactcaagaatcggtttacgctctgcgtccgtcaggtcttcgataatctgaatatctgtcagataatttgtcaccagctgatattccgatttactgtcttcaatatccttagacgcctgaatcatctgcttgcacaaatccactacatatttctttgcctgcgccgcgtccgacagattcagttcttttacaatgttctttgtctcaagctttgcatactcgctctgatcatattgtgagaaacttcctgtctcactttctttgttcttttttctatgaaataaatttgaaaaaatcatatgttataccttgcagctccttcgatactctttcttccactgaacaatcacatccattacttctttctttgccttccccttttgggcacccccggtccgctgcgctaattcttccagatgggattcaaactgttcgagtttttcgctcttacatgcgagggaaatttcatttctgatttcctgctgctttctctcctccacctgatatctttttgcaatttccgcaaacgcttcctcatcatgccggcagcggcagcacatcaggcactcccggagagattccttttgtttattcaatgcatatgccttctcaaagcagcgccctgcctcttcaaacaaaaagagacgtgcatacgccgttccgaggttatgccagagatttccccgcagaacctcactggtttccttcatatctgcttcgtctaacagatgtttataccggtaaatagctgccagatatttttccttctccatcagctggtctgcccggatcttgtcacgctcaaaatccgacttctgttccatctgccggaccgcaaaaacgatctcctgcatttctttcatggtacagtatgccgtatcctgcaatatggcaaaaacaaaatcggacaattttccttccgtgcggatattctccctgagtttttgtgcgagttcgacacgatgcatctgtttttccacccatgtacataaactctcgcacacgaaggaatgatccagaagatacacatttccggaaatataatagctgagttcttccatggaatatatgtttatcccggtttcctctatataatagggcagagccgcaattgtttcatgacaaagtaataattcacccatacgtttatcccatcattatgatacttttccatgcccggccggtagccgggaaaaattcaccaaatcccagatcccggatttccacttcaatcttatcatttgccaccggactggccgtaatccggagtcttgtcgtgcggtccggacgaaccggaagatcctcaagttccaccgtctgtatctggggagtactactgcttggaagctgctttaaaaattccacctgcggcgtgccgcttaggatcacctcacatgtattttttatctcaaaccagtttttcccggcactgacaagatttaaaaccttctttttttctttttccacgacacttaaactcagattaaatttcatctcgttttcgcccatgtaaatgaatggccagttttctcccatttcacggatgcgagccatatagcatgcccctttggaaaaaagattctgtcccagaaacgcgcgccgtccccggcagagaactgccagtgactgtttcatccattctccgtcaaacccgtccccgaccagataaaccgaagataccgaacggtttgcaaaacagttagtcagaagccttgcaaacgcctcatctttctcctctcccagttcctgtgccccggttgcgtgaattgtgatcatctgcggcttcgtatgcatatccctcaaaaggtcataggaactgacggcattcttcccgcaagaaaacaaaaacacatcgtgcatccacaaagatttctcctggttcatggcaaacgcatagaaactctctttgtcatcgatcaccgcaaatgtttcctgcgacaatcctaaaagttctgccacatgccggaaaatgccgatcaactctttcgtcagatgatccaccgtcaggacaattccggtcacatgcgaagtatttcccagtttctgcggcagttcaatcacttttttaataaacagtgccagcagatctactgcatcataactttcttttgcaatggtaatcacttccgatgcagcggcacggcgaagaagggaatccacacaaatcacctcactggtttttgccatccttccggcatcttccccataataccacatgccgacatttttgcgtcgggcaagcagcgtgggaatccggtaattttcactgccggcaatcgtgctgaccgtctccggttcttccatattcggttgcatataacttaccatggcatacgagtcgttcagttcgatgccaagataacaggtattggcttccatctcttctcccatcctgcttacaaaagcttaaatacttttttcgtcacctcatcatatcctgcgtactgtttcatcgtctgaaacatggaaacttcatcggataaagtctctgaaatcagcatctggttgatcagattgtacctgctttcatctttctgtgcatagatatcgttacaggtcagacgattactttccgtcgagacgaccttatttttatattcttcggtgatgtaatactggatctcctccccgaaaaataccacaaatgtttccacaaaaataccggcatagacattcggcatatccacttcgtgaaactgctccccgtcctcatcccggctgtagtgcagcacgacatgtttcttttgatttgtccggtgttccacataaattttgtcatacagatgatatttctgtaccagccgccggtccagtcttttataaaatgaaaaattcatatttcttccggtgaactctgccagcagtacatctgcggcttcatactgtgcctcctgcagagaggacatcccggaaaacgatttgagcagggcaagtttacaggcatcatttagtttctttccgctctgataccgtctccgtattatggcaaggatttgttttggcagcgcggcttcttttacaaaatagttctgcgcaaataccgtaatgaccgcaagaacaatcagttcctgcccaccgctttcataataatgcgcaaatacctccagtgcctgcataagatccatatccgtatacagcatctgctcaagaatccgttcttccagatctcttgtccgaagttcaaaatcctgtgctgctctccataaacgaagcatggtctcaaccggtccggaataaaaatcactcagatactgcagaatcctgtcattgtattttttgtttaaaaacgcacttgtacacaaaagcagcagttcctcgtcctgctccctctcttccatcgcatccagcagataggtggcaactgcaacctttgccgatgatccgatctgatccagcccatattcctgcatctgttcatacaaccggtcatacatccgccagtctgcaagggattccatcatatactgacgcaccgcctgcggcatctgctcataatctgcctgttccagatattgttccaccaggggtttttgctcttttttctgataataacgcacaatctccctggaaaaatacgactggtattccgtatccagctcctgtgcaaacagcactctccggaaaaatttttcctctttggcatcaaacatatgatgatccggcttttccccaaaatgggaaacaatatacggaagttcctccggtgccagtgccgtacatttctccagatacgatccggcatccatcagggaatccagccggtacgggacactgtggatatatctttggcctttcccatcttcaaacaaaatggcatattccctgcagaaaagggacacgtaggcacatccgtttacaatcggaacgatctgcggatctttcatctgcttctggtatacaatcgcgcggaccatatgcggctgcataattaccagcttatgcgcaaacagaatattggaaagacattttgcaagttcttcattcaccagccccagttcgagcatgtcctcataaaccaccgccagattatcgtccacatgttcctgctcgatctgttccatggcaaaacggctcatcacccggcgatactgttcataaatttccggttcgctttcctttgacgcaatgatattgttgtaaagaattgccatcttccgatagggaagattactgtcatactgaaagtacatccggataattttcggaaccgatgcaatctcccgttcatccagtgacatcagataagcctcgtataatccggtaatccgaagttcaagcccgattcccttttcataccagtggtgaaattttgtatcaaactgctgggttcttatcaggtaactgcagatctgtcccacatattccggtttttcctctgtcccgtaagctgcctgcatcagttcaaaatgaaccggatgaaatccctgattcatttccaccacttcaaaaatctgtgctgccagttccttcgtcagaacctgatgacggattgcccagcgcagaatccgcacttcaaatcttcccagttttgtgagcagatacgggtcatagctgatcagatcgtatgcctccagatacaggtacggggaaacacagccactcatcacccagtgcgcaattgcacgcagtttgtgcgcactgttgttgtaatattcctcttccagaaacgaaagaacccagaataacaaagcagaatccggattttcatgaaaaatcatttcaatctcatgcgtcatgcggtccacatatgccggttcccgttccagaagtgtcataatataaagataatacccccactccggtgtatggtgatcggaccattcccgtttaaattcctcaagaatccactccgcttcctgtttctggtgattgatcaccagtgcctgtgctttcatcagcggatacatcacctgatccggaagcatggcatgcagctggtttaaacgttctaccgactcatttgcccacacacctgtcacaatttttttcaggcggaatgcctcatacagttctaccagcccggactgacattccctgattttggcatgttctttttgttctttggacttttgtttttcccctttgtgcgcataaatctccagaacctttgtctcatataccgaggaaaaagtaattttggcataattgtttccggcatgcatccggtcatagtccacgatgtatttcaggacaaacgtactccccagaaaatcctccgaagtaatctgcgtctgtgccggctgtacaaacgcggcatcggaggtgatggcaagttccaaatatccccattcgctctttttgatttcgatcttctgctgctggctttcggtaagcgcatcaaaccggcagtctgtctcagaaattgtaaaatggatctgttcttttctgccggctgccaccaaaaattcttccagattctgcgacgatggttttgccgcaagaatcccctgatagtacatcttttcttttgtctcttttgcttttagaatattgggaaaactcttgtgataaaagagctgatatgcttcctgccagttttcctttgcaagtgccgtaaaatccgaaagactgcgaatcgcacctgtggcagtctgcgcatataaacgggatatggatacacaaaaagaaaggctgtgtacactctgattgcaaagaatcacaaacgcacccttttcctcctgcccctcaacgagacccttactatgaaactgataccgaatccgtatattttcgccttcaaactggggagtcaggcactccatccttgggtgggtggagtagacaatgcccctcaccggaatatggttttcactggtaatttcaaattccccggtatattcctgtccttctgtaaccgtaagaaacagttcctcgtccgaaatagaaagcgaaggctgatccgattcgaattttcctgcggctatctgcctgattctcttctgcacatccacacctgcttttctactagtatgtcttttattatatacgattccttatatgcatgcaagaaccagccccacttttacgcccttgaaaaacgggcatggatcatgcggcatctcacagaaatccactcaacaatcagactcagataccgaagaaccggttccgtaataattgcaaaaattaccatcagcatttcacactgtttggaaattcccgtaattccgaaaaagcttccgccaaacagcatgcaaagaatccatcctgcaatcacaccgaccagcattacaatatgtccggtgttcatcggtcttgcaatgcggtgaagaatcataaaaccaacaattgcaaccagaatggtacatgatgtagacagacaatccaaatctacctgaaattcccggcagaaaatcaccagaccacttactacgataaaatccgtcagtcctgccggaagtgcccgcacgagtacgttggtcaggaaatgtccgcggatcagctccttattcggctccagtgccagaacaaacgacggaataccaatcgtaaacatactgatcagcgatacctgtgatggttccagtggataatccagcatcagaatcacagagaaaatggcaagcagcatggagaaaatgttttttacaatatacaatgcggcggtccgctcaatattgtttaccacacggcgtccctctgcgaccaccgatggcattctggaaaaatcggaatctaaaagtaccagctgtgccacattagaagcggcttcgctgccggaggccatcgccacgctgcagtctgcatctttaagtgccagcacatcatttacaccatctccggtcatggcaaccgtttttttatgttctttcagtgcctgtaccagcatccgcttctggctcggggtcacacggccgaataccgtatactcttccaccgcgcgataataatcttctttttctttcagagtcgatgcatcgacaaaacgctccgcacccacaatccccgcctctgccgcaatgacggaaaccgtcagcggattgtcaccggaaatcaccttgatatcaacatcattttccgcaaaataagtaaaggtttcctttgcccctttgcggatcggattggcaagcatcacaaaacaaagcggaagtaccggctctgtcagcggtttccggtcaagcgtcccttcatattgcgcaaatacaagcacgcggtagcctttgctgctgtaggtggcaatctgttcctgatactgggcaaactgcccccgcagaacaaattccggtgctccgatcacataagatttcccatcgttcatcacggctccggaatacttcgtttccgaagaaaacgaatacacttcccttgcccgcataccacttccgtttgagaaatgcgctttgagtgcttccatcgtcgcattgtctttttcctgcgctgccacaaaatctgccagcagctgggaaatttccagctgatctgccccatccagaacagaaaaatcatagacatgcatccccggctcggtgatcgtgcctgttttatccacacaaagaacattgactctcgccagcgtctcaatacatttcatatcgtggatcaataccttcttctgtgccagccgcacggaactaaccgcaagtgccacacttgtcagcagatacagtccctccggaatcattccgatgatagccgccaccataccggtgatactgtcatgaaacgttccctcattgtaaataaacgactgcacgaacagagcaatcccgatcgggatgataataattcccatcaccatgatcagataattcagggagcggatcatttctgactgctctccctttttgcttttcgtcgcctgcagggtcagctttgaaatataagaatcttttccgaccttctcaagacgtgcacatgcctttccggataccacaaaacttccggaaagtagggaatccccctcccgtttttcaatttcatccgactctccggtgatcagggattcgttcacctgcagctctccggataccactttcgcatccgccggaatctggcttcccgccgaaaattccacaatatcatccagcaccagctgatctgccggaatctcctgccgctttccgtcacggattacaactgcatgcggtgcattcagaatggataatttatccagcacctttttggagtgtacctcctggataataccaatacaggtatttgccacaataatcggaagaaacagcatatccgaccatgcacccacaatagcaagcaaaaccgcaatcacagcaaatacaagattaaaatatgtgcagacatttgaacgcacaatttccggaaccgacaacgtggaagactctactttatagttgttttctccctgtgcaaaccttctttttacctgctctgcagacagcccggactgtggatctgctgcaattcgttccattctgactctgttttcctgttccatgataataattccatccgcttcctatgtatttttcgttaaattttcagatgaaattattataaccgattctttcacaaaagttgtccattttccaaatatttttcaaacatttaacaattgtttataaataatgccgtagcatgagtttctgatccctgatcacctataccatttttaccacccagacgttgcttcgtaccatgcagtatccaatcacgaccttgatcagctccgtggcctgtaccagaaaataaacacttacaattccaagtcccgtgccgtgtgccagcaaaaatgcaaccggcacaacaaccacccaggtaaacaccgaatcaaataaaaacgtaaccatcgttttcccaccggaacgaagcgtaaaataagacgcatgactaaacgaacaaaacggcatgatcagcgcagaaacggcgataaactttgtagccagatccttaatttccgctgtcgtattgtaaatatcagggaaaaatcccccaacgagaaacatgattgctgccataatcacacagcagaagacactgaaaacaatcatcttgttgtctgcgtcttttgccttttccagttctccggctcccaaatactgtcccacaacaatactgatacacgctcccaactgtatatagacaatgttaaacaaattggtaatcgtcgtggcaatattcagccctgccaccacatcaagtccacgcacagaatagcactgggtcacggtggtcatgcccgccgcccataaaacctcattgaacatcaggggaagccctttgatcagtaccgttttcagttcgctcaccgggattccaaatccgcgataagccccttccagataccggttcttctcccggtttctatgtgcccagaagacaacaataaccgcttccacataccgggcaatcacagtggcaagtgccgcccctgtcaccccaagttccggaaatggtcccacaccaaaaatcaacagataatccagcactgcattggttcccaccgccacaaaacttgccagcatcggaacgagcgtctgtcccgtttcttttatattggtggcatatgcctggttcactgcaaacggaaccagtcccaccagcataatcaccagatactgctttccatattgaagtgccacatcggttgctccatttcccgcagtatccgtcagatacagggaaatcagatccgatcccttcgtaagcagcagcaacatggtaagtcctgacacaagcagcgtcgcataaagcttaaaacgaaacgaatgcatatgtcccctgtgatctccattgccaaaatactgcgcaccaaaaatacttgccgccgacaccgctccaaaaattgccagattgtacacaaaaatcagctggtttacgattgcaacaccggacatctgttccgttcccagctgtcccaccataatgttgtccaaaaagctgaccagattcgtgatggcattttgcaggatcattggcactgccagcaataaataatggcggtaaaacgcacgatcccccatatacttctttttaaattttttccaataactcataaaaaacctctttcatattatttttcaatcctcttttcgaaatccctgatttaaaaattcattccatttcgcatttgtattctcccattcatgcttctgcataatccggttccggtcacttagaattgccagcatctcgtccacgatttccgccatcggaagtttcctgtaatgtgacaaatagccaagcatcctctgtgccgtccagtctgtgttcagattcagtgaaatctgctcacaaaactcctgtggaaagccacggttcaggagggtgttatataattccattgatttttgtgttctgggtttcatgtctttttgtatcctcatctaatcatggataatcctactttcgcgtaaattcatcaaattgatccataattttcataaaattgctcgtgctcacgcgataatgatgctgtaacaatttgtcagcattcacatccatgataagcttcttcgccttaaatgtcgccgcttctttttgttttttacttttctctacctgctttcctatatatacctgctcaatatccctgcaaaaccaaacaaatccatatccattttcttcacaatattgttttgcatttttcagaaaattttcatcctctgcattcgtgtcaaaattatcacaatcaaaacaatatattaccctggattgatttttcttagaagcagccttatattgtgaaatcagattttgaacatctttttcctttttctcataatttccccgtccgtccatatatacaacacttaattttacctgtgttcgatcaaacgcataaaaatgctcaatcgtgtccttgatatacatccagtcggactgacattttttgttcgtctcaacaacaaaaataaactgcctccccactattcatcctcctcacctgtaccaaaaactccgataaaatcaatcgcatctacattaaacggagaaccttctatcataccgtttctgtataattttgaaggtgaatagttgccatttgtcttccatggataaatctgatgatcctctgacaaaaagtctattgacttcttgtgctgtttcagaacatccatcggtccaacattatgtgttgtaaaacagagctgtccttctccatattccatcaaatattccaacaatgcacacaaataaacatcatgaaggttcgaatcaaattcatcaataaaaacaattccaccacgaaccatttctcttacatagacaaataatttaatcagttttttgattccggtactttcaaattctgcatgaatcttgtaggaatcatacaccataaccaaatcacacatccaaaaatcgccgttttcttttttatcaatctctatacccatcagatccgatttaaaaatatggagaaattcatataatttattgattgtttctataaatttatcaagccttggttttgcaatcatatttcggttactgaatattacatttatgttttcattctgtaactcaaaaatattacctatcaacgaatacaattttgcattttgcgaatcaacatcgtcacaagagagaatggtattttgtatcatatatggtttatgatcatctgactcatctaaatacacatgcagcttatgtccaaatgaaaacagcacactgatagcattcattattacccgtgcaactttatcctctctataaaaggaataattaccgtcccctgagtataacatatttacataaatcaatgcacatgcagatcccgtggtcaacaaattcatcgtcttatttctaatttcaaccacaaaaccattttcttcctccaaaccatacataaaaatgatttcaccatcacaaatttcataaatgatttccagagaactgttctttgatgtcgcatttttttcttttaaacattcgtgtgatattgtaaatttacctgccttatttttagacaaggtgattccatactgaaaaagaagcaactgtgcaccactctttgcgataaactctgcttctatcgaaagttccccaactttcttattgacaatagcatccaaatgtttctgtgcaaccggattattcaaatatcctgtatcaatgataagattgcgcaaaatttccacagaagtcacgatccccgattttccagacccattcattccataaattcccttaatattatattcctgcgtatccggttccttattgattgttttcttataaaaagacaatgaaaccgttttatccaatgtcttgattccattaacagaataatttgttaaatagatatccttcatcctggtatccctccatctttgcttccaatataacacaaaaggacagaaaaataaatacaaaatgtatttttccatccttcgtaatcgtaatttatttcattatctctcaattttacatcaattcaattaaaaacatctcgtacagatcatcctctccctgcaacagcggcgaattctcgccgcctccattcgtggagcgacgcattgctgcgtaagaatcctcaccggcagagaccagatccatagcggaaaaggtgcatccatgctcctgtgcaatacggcagaatgcggaaaccggatttttcattccccgcgtggctaacaacgcctgcgcaagttccggattggatcgagccctggcttttaaattttccaattcatcatatatgttcatcgtgttttcctttctcatccatctgtaaccttgttatgtcacacatctttcctgcctattcttttaaactcacaaaaaatgctctcctgccggtcagattacctctgcgccaaatggcatcagggataattttgcaattttgaaaaactgctttccaaagtatgtttcttaatatgctcatatcaatactccttttctatctcaccatctattccatacattttcttgaattcgtcaagatccgcctgactcttaatcagcataacctcttcgatcttacctgtatggatgtccttaaaaccggcaacctgctcaccgttacagatgcttgccttaattaccggcttcttattttctttatcataagtctttataactgtctttttcttaaataatcccactctgagcaccttcttttgattttgccatcaatatgagtttttcaaaagactgagcaaagcgtacatcatcttcctctgtacgctttctcggtcccttcatatgattcttatgcgagctgcgtcttgccttcttgttaagatgccgctccataagcatctggtcaatattttcatttgtgtaccacttaccggattggtgaatggcatacgccccttttccaagtgccatagcagctacaccataatcctgagatactatgacatcccctttatgacaaatgctaatcagcttgtaatctacagcatctgctcctgcaccaactacgatcacttcgctatagtctgaatataatacgtgattcgtatcacacagcaatgtggctggaatactatatttctttgctatttcttctacaatgcctactacaggacacgcatctgcatctacaaatatctgcattttcataatttctttttctgcctttccagttctttttgaatccatgtcataattatatctacaagataatcctgctgcacctgactcagttccctgcccggctgcattttgtgccacttccggatacactctctgcagcatgttgcagttgcatgttgggcaataaataccggatggcccctcataggagtctgtttgccatcatttgctataaatgcgggagcttctctctttgcaataaagtcctttgcatgttgtctgatcgtatcaagtcccttttggtttatgtaatctatgtctttctgcttcaaatgaaagctgcttcgaaatttggaattgtccagtctctcgaacaactgcctgtaccactcgtcctttgtcatcagaacttcactactcgttccataatgtaagcctcctgttatttatctaataatgtaatttttattttcagtataacccataaataattctcaaatcaatgccttccggaattgttctaatccatctatgcagagagcctgcataaattactttttatctcaaattagccactggagaaatacgatcaagaagataaacttcctctcctgttttctccggattatctgtgcccagttcttttgcaatcgaacggaatttttgcaaatcctttcgctccgttgcaccaggcatcatatctggaacgcctttcagtaatccgagcaaattcagtatcgtattcaaataagatccaaaatttaataaaccggtagttccaagcataaaatcgacaatacttgtcgatttcgcagttcgttccgaagcctctgccaaaatattattatactcccgaatcttttgtcttcgatctgtttcttccatcttctccagattttccaaaatagcccggaacttcaaaggtgtctggtacttgtctgccatgtttgcagtacgcaaaatatcaatattttcttttgtgtcgaagaattccagcatatttctttctgtataatttgtattccaaatcgactgcatccgcttcacttgctctggtgcataccaatataccttcatcattccttccatcatagaagtctctgcctcatccgtatatattttattatcattttctgcacgaaacggaaaatatgttgcatccaaagccatggctagatgtgccgattccgcctttgaaataaattcaaattcaattgcactcttctgatcatgctccctgaaaaaattatatgccaactgattaatgccgaaattactgactgccataggactcgaattttgcaaaatgccaaaactttctcccactactctatatggccataccaacagttctgatatatgaagtgccacttcatcctgtttctgatttccatatttttcaagttgcgatgccatctcataagccatcggataattggcagcatactgatttttcatctcaaccaactgtgcaatcatcatcgcattcatagctcttcttccaattacagaatccggtgactctttgtaagcatccaaaataacctgccgatcatacctcgtctcatcatttcctaacaaaagaactactttccccattgaaacaagttggaccagctctttctttttcatgccctgcatttccaaaaactcatccaaaaaattttcaattggcaaagcaagatacaccgtatcatataataataaaaggctgcgtagattgatcaccggaaaaacagacgcattcacaaagcattttagttcgccatctctgcaaaaagataaatcctttctctttacagagccatcataaattgcctctatattgtcataccagaaatctgtctcagcaactgtaaacggataactcttgttcgtatttaaccacataacgctgtcctgcggatttaattttgttttatcttccggaggttccgttgtacgaagtacctgaatctgatccgttccaaagtcaacttctgtcagttccttttgcaaccttgcgatctgtttgtcactcacatcacttccaacataaatatccatatgaaaatttatgccgccttcactcggaacaatttttctaatgtcaaaatcatggtatcttccataaatatattcttctatctcagctctggtcctcgctgttgcccgaaaatcatccaccggatgttccatatcaattggagagagttcctctatataatgttccggcacctgatccgataatgatatctgcaaagtaacataccttatggagcgatcaaaatatgtctttattttttcaaaatcgtctggtatattggaacataaaatcacatacttaaagggagctattttaaatattctggttttgatacctatgtattttagacgtaatgacaagtcattgcgcctgactttattgtcatttgttaatatgagatcaccacctttgtatatcaccaaaattgatattttcttttttcaatttctaccttaaatgcactattatatcaataatttatgattataactttattcagattcttcagaaaataaagatatttttgaacgaattatttgctgtatacttattcttctaacgccacttcgtatttctgttttttccactcctcttgatgttttctatttataagcaaataaatctcatctttcaatttctgaacctctgcaatttcattttctaaagaatcactattttttgatgctacaaatttatatatatgattctgaatttctttcattttactttttaattctttatcatcgtcataatcatgtaatgaaatagccattgcatattgatactttaataactcctcatatttttgtattctattttctctctgtaaaaatattgaatctacaatagccaaataggaggaaccattactttgcaaactactcgcccaccgttctcttgatgccgttacggtatttatatatccgtttttatttgctatctttctcgtattacttagacttaaaaatgatacaattactgaaataccagaaaatgcacatgttattactaaaacgattttatttatatccataaaaattttcccatttctttccaaattatattttttcttttatctattctaatttaaagcatatttgtagtcaattaattgccataattatttttccacatataaatagtttctttactgcaattttgttagacactctttttatttaactctttcataatacttctccaaatcctcttccatctgcaccttcactctttcaaaatcttgcttactcattttaataaaaagcgcatgattcatagaaatcacattcaaatcctttgaataatacaggaaccgtttacgctcaaatttttcaaaaggatttgtcagcatattgcttttaatatatttccgatctttcaatcgttctgcattatatggacaacttgaccgatctaccggaagttccttatcaatcctgtcttggtaaaaagcaatataatctgtgagcacattatcaatttttgcatctccaatttcattcatattttttaggaatgaaagaagaaacggcatcttgtaagaaagactgtaatcacgttcttccagaaaatcaaagaagtccgttttgatcgtttcctctgtatgttctggaatattattttcctcacgaatctgcttcacatgttctggtgcaaaaagataaattttcctacttccaaaagcaatcatttcatccggagaaatttttcctttggtaacccagctggtaatagttcccgtacttaaataaaattctctcgccagctgttcctgatttaagtaatcaccatatttttcttcgaaagtttcaatgtccacctgcacaatacgttctactgtttcatgcagaccatctacttctatcatatctcccacggaataatctctttttaaaatacttccaaatgcagtgtaaaatggattagaaaaaattgaatgcatggaacacggctttgccatggcaccatattcatctactacgtcaatgacaaacacgttcgtttttgtatttgtccgacgaagtcctctaccaatttgctgcatataaagaaccttcgaaagcgttggccgtgccattaccagaattccaagttccggataatcccatccctccgaaatcatttcacaagcacacaaaaaacgtatttttttctctcgaaactgctgcataacttcatccgcatttcttgtttttctggtatatgcctttgccaaaagacctttctcatttaaaatacgctccatctcctgtgcatgatttgtatttacacaaaacaccactccctgcaactgcccagcttttccttccgaaaaatagttgtataacacatccgcaatcaattcatttctggactttacacgaatactcttttccaaatcagcattaatataatctttgccattaaatcgaatatgactcaaatccagattggtttcaatacgacacacatttgcctctgcaacaattttctttttcatcgcatcaaccagagataagcctgtcttataattaccaaatattgtctccaacttctttttgtctggtcgttgatctgttgctgtaagaccaatcaaaaaatcaggcgtaaaatactgaataactcgttttaaaactgtggaaactgcgtgatgagcttctgctcgtgtcaagtaagaaacaaaaaaaaattaattttttttatcaatggggaacctttagcaagattccccatgttacttctttataattttgttttctcgctattactactgattataccatcatccagcctgaaagtcatcaaagttccatctgatttcaatatgctcattatcatacaccaacacataatcaatgagatatctgattacttcttcatcaaactcatccaacttactaagctttgttagctgttcctgctttgcatcaagaaagagatccttttgcatatcaagtgtttcctgcttctctgtaatcagactttctatctctgcgattttctgcttaacttctgcagtcttttttgccatctgatcacgagtgatatttgtttttgtataatcatcgtatatctcaaactttagctttgcatagtgtgcctttgactttttaagtgattcgatttccctttcaagattatctggacaattaccgccatcagttttcaactcaaattcctgcaactgagccaatgccatatttctagcaatgtctagaagtgtcgcctcaagttcttcacctctaatacgtgacacatgaccgttgtggcatctgtatgaggatttatttccgtatttataaagtcccttaccacatattccacagcgaatatacgatttacgccactttccatttggttttctcttcgtcacttctcgtcttgctatcatcttgtgagcaagcttgaagtcttccacagaaactaatggttcatgacagttttcaacaattatccagtcctctttatctctctgcacaacctgatgaccggtatcaatattatcagccgtcttgttattgattacagaaccaatatagacttcattatataaaatctccattactgtactggcactccacatgtgctcaccaatatccctttcataacatctcttaactccaatcttttggtaatactcaaatatgctatcatatccattattattcagataatttgcaatctcggtgtatttcatgcctttaatagccagttcaaatatcagctggacaacaggtgctgttactgggtcaggcactaacatatgcttatcatcttcacttttctggtatccaaaaggagcaaatgcagcaatgtactttccctgcttagccaacactgccttagcggctcttaccttttttgatgcatccttacaatacaatgcattcacaagatttttcagtgcaacactcatacctccggttgaaccaaagctgttagcagaatcgtaattatcattcacgctgatatatcttacctgaagaaccggaaatatacattccatatagttaccaacttcaagataatctcgtccgagtctgctgtagtccttcgtcacaataacctgaatcttaccagcctttaccagatccatcatttttacaaaattaggtctgctaaagtctgctccggaatatccatcatctgaaaattccattatgttgcagtcctttagttcaggcagtttctggatatgatcaagcattaactttcgctgatgggaaatactgttactttcctcatgagcagccaagttgtcatcttcatctgataatctcatatagagagctatcgtcttatccattgctgctcacctctctttcttctgccactttaagcaactcctttaggaaatcatcatacaagagcttaacttctatattgccatcataaaaaacaatttccgatacaaaagcatccacaagctcctttgtaagttttcttttagccatatatttattgacagtttcttcccatccttcatcaatatgaaattctttttcatacagacttcttcgatgaagcaattcagtaatctgcgcttcaatctcatttactctgctttcatattctctctgatactggcacagttcttccgcagtgattaactgttccctataatcttcatacaaaccacttttgttagcggtaattcttcttacatcattttgaagttttgctatctgcttggtataaatatcatattgaagaacattctcttttctgctgttcatcttctgaacaaactttgttttctcaacacacaaactcatatgctgacggataacagaaaaaacactatccataacctcagaataatcataagagtacttattttcacatagcctagctaattttctacggttcttacacttataatagaacttttctgaataagtgtgatgcctgccaatcaatacactgcctccacaacaggcgcattttgttttatataccagaatattatccggcttatttggaacatcagctttaggttttgatgcttctaaatgcttctttttgatatgctccattctctcccttgttttgtagaaagtgtccttatcaattattggttcatgaacattttctattcgctgccatgctgatgcatctgttttaacattctttctcccggtatcaagagccttcctttgctttccatgaacaatatttccaatgtaatattccccttggagtatctcttttacatgcgaatagtgccattctcttgctttttcagcaagttcaatctttcctgacttatagaatctgtatttcggaggtgaaagaattccttcgtattgcaaagtctttgcaataccagcatatcccttcccatccaaaaacatattaaaaattctaactacattgtcagatacctcttcatcaatcaaaagctttcttgaaccatctgtagccctgtaatatccatatggtggcgttccctcgctgaagccgccctgtgcccaaatactatgctttccggtctctactttctttgaaaggtctttggaataatattcgttcacaatattcttaaacggtacggataaatcagttcccggtcttgcagtatcaaaatcatctgtgatagcaatatatctcacatcaagaaaaggaaataccctctcaatgtagttgcctgcttccacataatttctgccaagtctgctaagatcacgagtaataacagtattgattttgcctgcccggatatcatgaatcatacggtcaaattccggtctttcaaaagttgttcctgtaacagatatatcagcatacacacaaacttctaccatatcatcctgcccattaataaactctctgatatatgcaatctgtgtatctacagtatctctttccttattcgcctctgattcgaatgaaagtctcgcatagattccaacctgatatggttttgcctccttatccaggcttaaaactgcttttgttgtcagattgtcagttggctctgcaactgcaatcggcgtattttttctactctttcttgccatactacacagcctcctttaatctgatattcagttttcccgtactgtccacttcaacaaaatgtccctgactttctattacatcaagacattccttgtagcagtcatcaaagtcaaacactacttcaatgtgattcttatcaaatacctttatttcacggataagagatacaaccacttccctcgtgagtttctcaatgtttttatgttccgtaaaataatcaagccatacaaagcctttgctcttacgattcaacacatcatccatttccaattcaatctgatgaatagcaatctcagcattcttttttctctgctcatatgctgcatgaagttccttgtaatcttcctttgaaataataccatccttcatatcctcataaagcattcctctgagatctgcacatctgtctacttctgcctgtttcttttcacgcctttcctcaagctttttcatatcaagctgctgaaacggcacgttgccgataaaagaaagaattcttttaaggtcaatcatgttatcaatgtgtgtctgtaaaagctctagcaccacttcttccaacttatccgtggaaattctgtgggaactgcactgctttgaatccttatgggttgcacacagataataggcataagttttaccacccacttttgaagtttttcttaccatgggaatcccacagccgccacaggtaactacccctgacagcggataaacttcctctctgtccggtgatgttcttgtatccattgcaagcaatctctgtactacttcaaaatccctgtccgtgataaccggctcatggttcttttcaatccttatccattcgcatttttctttgattatggtctttttgaccttgtgattcggtgttgtctgttttccctgtacgagattacctatataaacctcatttgtaaggattctccttaccatgactgaagtccactccgacttttcttttgtcttaaagcatgtctgataattgcttcctgtgcttgctttatactcagccggtggaagtattcctgatgaattaagttcacatgcaattgcatcctgactttttccatgcaacttcattctgaaaatatctttcacaacatttgctgcatatacatcaatttccagtttgtgcttatctttatcattctttttgtatccatatggcacaaatgccgtgattacatctccctgctttctcttaatttcaagatgtgaacgtatcttaattgaaatatcacgacagtaagcatcattaataagatttttgaatggaataataatctcatctgactgcgactttgcctctccggaatcaataccatcattgattgcaataaatcttactcccatagcagggaataatcgctcaatatacatacctgaatctatatattctcttccgaatctgctcagatccttagtgacaacgcaatcaattttgcctttcttaatatcttcaagcatcatctggaatgccggtcgctcaaaattagagccgctgaaaccatcatcaacatactcctgcacaacctcaatatcatttttgttttcgagaaaatctctaatcagtgatttctgatttgcgatactgttactctcagttttttcatgtgaagcaacagcgccatcttccttcgataaacgaacatagatggctgcatgatagatctttttgatctgacttatctgactcatatgcacatcctcctattgttgtttaagttagaagataacttttcaataaggtgatatgcactaatttagaatttttataccaaaaacatcatagcacatatcactttgaaattccaccacaaattttcagacattcaaaagcagattttcaaatgcctgttccatcgacagtccattattcgcaaagcttaccttaatcatcatacttccacgacgcagcatatatggatttcccacctgttttaagaactgtgcctgcctcttactctgtggctgatttttatctattttaatttttctaatatcagtcagatcttctatttttacattgttaaaatccacatctaatagtgctctgtattcttctgctgtcataaaatctatccccctttcagtaaaaatgccacccatagaatacaggtggctatgtaacccggagcaaatgccccggtaatatttaattgtacttttcatatgccccaatctggatttttacacattcagtaatcttatcaagtagttccgtatctgaaattgaagcaactaccctctcaatatggacatttacatcaatggatacaatctgctcacataatgccatactgtcaaatacctcaaaatctgtgtcagtaacctttacctttgcagccggtattggacagtgggttggcagatatttctttttccatgtttttgtggacatggctactgctgtgacaaccggtgaatactgatttgccttgttatttgagataataatataaggtcttgtatacttctgaatgctccctttacttactgactccagatttgcaataacaatatcgcccctgttcagtttcatctatgtcattcctcctgttccccgatatactcttctgcctcatcctctgtcggacaggcaacaatccgtttcccatgttcatcaatcactactgtttcgcccggaaatgtaatcagttttaattttctattttcttctgtcatatcattcaaaagaaatggggctgtaaaataagtccctaatataagaaacgccaattccggcaaatgtcggttgaagttttaccctcatagagcgatgtttgtgcgtcaacgtgtcgcaccaaagatgttctccacctcacggctggaaagcaggtctttgacattctgggtgattcctgttgggatctgtttgtgattatcagacagttttttatctgtctctccggggatttctcccattttcagcggtgtgtcatttcacacccggcatagcatatctttttatctgacagctctgcgctgcctgccgaaatgatagcgggaactcgtggagctattatattccggatcatcacagaccaggggtcaagctctatgcgttgcgtgtgtacctgctattacacagagacttccactcggattaggattgcaaaaccctttccgtttctttcccactgataatcctgactgtctgaatcggcttcggtcaggacggcatactctgtgtttccatgcaaaatcaaaacacaaagtaatttacctccccattttctgaatcgcttccagatttccaccgtataagcggcggtctgctcctccttcaaaagtaggtgcatctcgtcgatgtagtaacgggtggacttgtgagcggcacggttgatggtaacgcggttccacacctgatcctggaccaccagcataccgattttcttgagctgcttgcccagttccttaatgtcatagcagacaatgcggttattgatgtccacattgctctggtggttgaacacattgagggagccggttacatagatttcaagggccgtggcgatatactgggcttccttttcctcctgtgaacggagcaggttatataggtcctccagtatgggcatattctccgggcgcgggtcgttgaggtaggtctgatagaccagacgcacacaacggtcgatgatggttttctgcaccggctgcaatccgtccttaccgcccacgatcagctcacacaagctgaggataaaatcagacttgagggacagcgggctttcatcatccgaatagtccaggttcaggtccatcggattgatgtaattggttgaggtaggcgagatcttgatgacctgcccatgcagacgctcaacaagaggtgcgtactcagcttccgggtcacagatgataacatcatcattggtaagcaaaaagcagttggcgatttctcgttttgcactgaaggacttaccggaacccggcgtacccaaaatcaagccattggggtttttcagcagctttcggtccaccatgatgaggttgttggacagagcattgatgccgtagtacagagcttctttgccgttctgaaacagttcctgtgtggtgaacggtacaaagatagccgtagaactggtggtcagccctcgctggatctcgatctgattgagtcccagaggcagacagctcatcagcccttcttcctgctgaaagtccagtctggtcagctgacagttatacttctgggcaatagagcctgcctgaaagatgttgttgccaagctgacggggattgtccgctgtgttcagcaccaaaaaggagacaaggaacattctctcgtttcggctctgcaaatcctgcaacagctttttcgcttcactgccgtaggtggcaaggtcagagggaatgatgtccatgtcgtatcctgcgcggactgcttttttctgttcctcgatcttactgcgatccaggtcggtaatcttgcgctttaccgttttgatggcttttacctgatccaccgactgaatgtgcatactcacaatgagcgagctttccatatccagaaaatcagccagcagacggtcattcagctctggggctaaaatctgcaaaaaagaaacagccccgtatttcttgcccatacggaactgcttgccggtgcggaactcaaaggagcttggtgcaataaaatctttcgtagacaaaccggaaggagccagccagtcccattcaaactgaaatgggagctgttcgtccatgtggaataccgcatgaagctgggaaagcctttccttaccgtccagtgttctggcggctacgccaagacgcttgaagttattgagtatatcggtctcaatgcgctccaggcggggcttggcagctttgatactgtccgcgtcgataccaaaggtcaggtatttggtcttgatgagaccgttgttgcctctggccagctgattttgcagcatcgtggtgtattcctcacggatactgtcaaaggcatccccctggggcgggatggaaatggagttggcaaaggtctcctccgatgccgcaaggttcagaaaagacaactggaagtgaatcgagctgtcgaaataattgaggaaatcacaccagccctcaaagatcgcggtcttatcttcattttgggagagctgatagttgatgtcctgaaactgaatggtctttgtgtagtgactgtccgatacgcggcagatcccgtccgaccacatccgttcataggggatactgtcctgtgccgattttccttttttgtccgtgcggttggcgcgggcaatggccacttcgatctgcttcttatcggcgcgggacagctttttctttgtctttaccggctgcacggtcttttcttccggttttcccagtagacggcgcaaccagcttttcattgcggtgaacaatgtcatacacctccttatcgagcatttcctgccgctttaatacggcataaaagttattggtctggtagggacgctgcttgggacggatcacagctactttgagaatgttgccgacgatcttttccaggggctgtccatgcttttcatacattgccagcaggaagaagggcatcatgaccagcatcatacacatggcggccatgctgtttcccgcaggctcacggagcaaaaagaacagcggtacgcctacaagcgccccggcggtaaagcagaccaactgccttcgggtcagattgaacatgacctttgttttgactttggttaaatctttgggtacgggtacataagccaatgtggaaacctccttccgttttaatgcgcctgaaagactgattttgcgagactgccggttttgaacagcgtaaagcacagcagtacggtgtaacccacgcagctccagatcgccatgatgatgtcatcttccaaagcgatgttctgcaccagcacagcataaattgccacgcagacgatgatgagaaacgcctgaaagcccagcgccagcagggaacggaggtagttctgtcccataccgccccattccttgcccatcatggcagccattggaacgggagccaccgaagtcacaaggtaaatctcgatcatacggccataaatgacgataaagatacagatatacagcgcccacatggtaatgccaataaagagggattggaaccaaagcccgaacagcggtcccagatccatttccatcagtctcggttccagatcggtcataactgaggaaatgtcaatggacgcatccgaaccgatgatccctgccgcctgtgccaccacgctctgtgccatatcaaagacacccatcacgatattccatgtgtttgtgacaatgaggatggcggcggctgatttgaacacccacttgaaaatcatccaggtatccacatcatgcaggttgttcttgtctgcgatcatctggatcaggtctacggtcatcacgatagccaggatcacgcctgcaatcggcaccatgatggagttggacagattctcaatcatactgaaaatactgccattccatccctgtggggtctgtcctacctgtacggatatatccgcgacctgttggtttacgctgtcaaacatccccgaaaggttgctcataataccgcccaccagcatttctttcagccaatttgtcagggcttcaagtaagaaatccatacggtgtcaacctcctttccgccgcccccgcaaagctgcgggagcggcaaggatttcatgcagggacgcttagacagagaaaagaccggagagcagaggtacaaggaccatgccgactacggctacaccagcgccggccataagctgcttcatgccctgggattttgcaccagggttgtcgttgccgtaaccttcgagcaggttgataacgccccagataccgagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccgcccgggtttcgggggcatgattccggctgtcctcctttttcattattttttcttgcgattgtccgctttgtacgccaatggcccgtagagggcaggtgcggcgaatagataagatcactcccttcaaaagcgaacagtgttaagcgccctttgtgtctacttcatatacatcgcagacctcattgggcttgagtttcagccttgcggacaggaatgcttcaatgtcaaaagcgttcttatcgtccgcgtcggcagtgtacttgaaattggggtgcttggtaatgtcgtacttatccgaaaggaaaggacgcacaccacgcaactggaggatacacttgccgccatccataacagcaagctcatcctggctcatcagctctttccccaatttttgatagttgagcgagtgggaggtttcccgaccacggctctctccggtgttgtaggtgtcgatggtttccttgcccagcacggcagccagctccttgagggtggttggctccttaccgcccaggaagatggaagtatccatgttgccgatgatggtatccgcattatccttatagatcgccttgagctgactctgcgcctgcaacaccagacaggcggagatctcacggcttcggatggtagcgaccagcttttccaaacgaggaatctgcccgatattggcggcttcatcaattaagcagcgtacatggactgggagcctgccgccatacacatcgtccgccttttcacacaagaggttgaacagctgggtgtagcacatggagatcaaaaagttaaagctatcgtccgtgtcgctcataatgaggaacagggcagttttccggtctcccagagtgtccagctccagctcatcataggctgtgacctcacgcagctctgcaatgtcgaacaccgcaagacgcgcaccacaggaaatcaggatcgacttggctgtttttccggcggccagcttatatttcttatactggcgcaccgcaaagtggtttggcttctcggcttccagcgcatcaaacatcagatctacggggtttttgaactcctcgtcatcctcacggacttccatagcgttgatgaactcaatgagggtggagaagttctgctcctccaccggagcctcatagtggatatacccaatcagcgcgcaatacagcaaggtctctgctttgacccagaaatcgtccccggccttgccttcgtagagtaggaatgagccgccttgcggcattactgccgtaggtttgcccaaacccctcccagaaccggacgtacacctctcgatgtatccggctcgccatcattgcttcaaatcagcgtcgttcaagggtgatgaatcttgtgatgacagtccttgcacaccgcaagcgttttacgctttttggctatcatcgcaagctcccacaattgttttcctttgaggttcttcactttgtttacatggtgtatttccagcggtacattggtttttccgcacagctcacacacgcaggcggacagtctgtcgtcaaatgatgttcgggaaccgacgtgtgcgattgcaaagtctatgattttatctgtccagaggtctgtatttttgcagtccataaaccttgcgaaactgcggcgctttattcctgctttcgtttggtagggcacaccccagccgccgtttccgtctcggtatttgcgcattatttttctgctggtgctttcatgctttccagccagagttttcaggcagctgtattccatcaaatattcaaaatactgaagcttgttgaaattgctggctatactgtaatagttgcaaataccgcgcagctcagagttgtacgttgatacaatctccaaatccgtacaccgaaagatatattttcttgcgataggctctattgttccgtcgcgcagttgccggatgaccggcttttcaaacagaaaaggcatgattttgtccgcatacggaatgcacagctccacagacccgttgagcgtgcgggaaacgtggtttccgtgcggctttagtttctggtctctcctcacgcggatgtcataacccaaaaatcttgcatactggttgctgtgcgtaatgagtgtcttttgctctgaaagctccattttcagggtttggctgataaagtcggacagctgtctcttgatacgctcacagtccgctttatcgcccttcacaccaagaatgaaatcatcggcataacggatgtatttgatgactttatcggttttggacatacagggcgttttatgcatgactgcttttaattgagcgattttctgcaacaaagctgttttttcctgacccgttgcggttttcagctgtttttgagccttctttatctgccatgtgaccttatcgtattccggggtatggtgcctgtccctgcttttatagaactctttggcggtcttttccacgaacttgtccagctcattcaggtagatatttgcgagtatgggcgaaacgatgccgccctgcgggcagccggagtaggtagcatggtattgccagtcctccatataaccagcttttaggaatttccaaatgagctgaatcagccgtgcgtctttaatcttggcgtttatgacgtttaccaaaacctggtggttgatgttatcaaaacagcccttaatatcgccctcaataaaccacgacacacctgaaaattctcttttcaaggattttagcgcagtgtggcaactcctgttgggacgaaagccgtgagagttgtttgaaaaaattggctcgtagaccgattccaatatcattctcaatacttcctgcaccagcttgtccgtaaaggtaggaatacccagaggacgttttttcgtgctgttctgctttttctggatgtactcgcgccgaacaggattcggcgtataggttccgtcagccagagattggatgatccggtcaactttttccttgctgaatccgtcagccgtgtcgtcattcacgccttttgttcctgcgcccttgttggcgtagaggtttttgtacgcaagataatacagatcgggtcttaatagatagcggtagagccttgtgaagatttcctctttgttgtcccttgaattttttctgattctatccaaaatctcgattgttggttgcatttgaggctttcctccctaatcaaatttcaattttggaatgcaataactgttctccttcgtctggaatacaggatatattccgtgagagtcgttacgtcccacaagactactatgagaactccgttgccatatcggatattcagcgtcatctcccttgcctttcgagggcttgggatttatcacccgcagggggcatttcgcatagctcgtttgagcattccgacttaggcaatccccagttagcgtaataagtaggcaaatgcggattgtcggatacgctttcgtttcgttatttccagttctctggcttgtcacatgaatggattgataacccatcgcgcaaaggcgaaacgcaatgttattcatgtcagaggttgatgccgccgtatctacggtggttacatacacattcctccgcccgaacacaacggggacttgaaactcgcattcaacattcagtagttttatcctcatatccacttaacgtagcaattcagtcgtgctcttgtgcatagagcaacttatcgctttcccgccatgctatggtcccgcatcagctttcgcctatcggttaggcgggtcgtttccactgttatctgagtgggtagtgcctgattctacttcttactacgccctatctgggcgcgcgcctttggtattggcgatcagcgttgttaccagcttcaaaatgtccttttcgctatggatataggcaaaagggttatagtgcatggacttcttgaagttgatggtatttaggaccttgatgcggtaaggttcataaatgaccttgccgtgcttatccttcatgggctttccgtccttgcccagcttgggcgcgcccctttggagcattttcccgcactccaccaaaatggttcccttggggtctgtgactacataagaactgtgcatctgcatcaaattcggtttgagccagaatctggttttaccggaaccggagccgccgatcaccagcacatttttgtttctggcggtctttgggtccttggggcggctgttcatggtcaggctttcggtttttgtgagaatgacattgttctggaataccgggtcgatatagggagcaatatcctcacgggttccccaacgggcagaaccatactccatgccgtgacggtacttcttggcgtttttacttttgagatacaccgccagacgcaggccggcaccgcagcacagccccaccagcagatccaacaggtgcaggctgggccagaaactttgcagcgccccaggcaggacagcaaacagggaaaggaatttctctgaagcatttgccccctgtgccagccgccatgcctccccgaagttggtagcaaacagccccatcaggagatagggcaggttcagcaaaacgagctttttgatgtcaagctgctttttcatcgttccagctcctttcgcttagtgcggtccaccacggcatttttgaccatctctttgaactgactgagttttgccagcacagacgggcgttccgttttctcggccttcttgatctttttgctggtgtactcggtaaatgcagcggtcagcgcatcggcatcacggcctttgaaaaagatcaggtacttgggcggggagctgctgcggtctttcttcacagcataatccacaccatatttccgggcgatcttctcaaattccttgatggaagggtctgtgatctcgatattggagatcccctgattctgaccaatgagctgcttgacggtctgttttccgtggggtgtcacaggagcatcacggcttcttttcttttgcagcttcttttccttgcagtgggccatgtacttgctgatggcggctttgagcagccgaccggtgaactttgttccgctgacaaccagcgttaaagtcctgttttccacttcttcctgcattttcatcgcctcctttccacaaaatgtgcaggggtggtgcatttctttctaaggcgggaccaccagacgccggagaagatatttcttcatcgctccatcccgcagctctttttctttaccggcttcttatccggcagattccactcttcccgaaactctgccacacctttggggtcaaatgccttcaacttctccagatcaaaggcaacagcagaatatttcccataaccggactgaacctgatagggaagcaccttccccaatttgttctctttgatgaatctcagcaggtccttgctgatgtcaccggaaataaacgcctctccggggtccagggaataccctggaaggttcaccgtcatatctgcaaacggctctgctccatcttctgtatgggtaatcatgccgatatagaaccgctgattattcgcatacattccaagttgcagcgatatggtttcttccccgtattcccacttgaagggtactttcttttcctcattcatatcggattcctcctatcgtatctgttctttgtggtcataaaacaaatctccatttctgacctttgcatggctgagaatcttgatctgcccctttgcctgactgtccagagctttttcatagcctatatctgacaaaaacaggcgggtgcgttctcctttccagcccaccggggagtcatgcgtcagcacatcaaaaataatcatgtgccgcgtgttctccgcaaatcgctggagatccatgtagtcatggccgtggtagttctgcgccccggctttctggcgcatttcctccatcagctgaccgattgttttgccttcctgcataaaacccacttcctttctgttcttatgagaccagcaagatcatctcccgcagctgtgcaaaatagagcttgccctggggcgtgaccagcgtgtaggaaccggtatgaccgtggttgcagtagtctttgacgcaaaacagtcctgcatttttcacattggcataaggcagaacattgccggatgccgtgcggtacacaaaccgccgttctatcagaaaccggacaaaccggcgctccgggacatccaactctttggcggtagtcctgagattggtgctgtgctttaagtcgatgaacaggtcatagaaagcggctttgccctccagctgtgcattttccttacgcagagaaatatttgcttcacgctcagccaacaggtctgagcagagcttcatcagagcttccggggaagtggctacctcccacagcttctcttttgtgagataggctccgtgcttgcgaatggtaggcaggacctcatcgaatacccaccgttcaaactgctctgccgatggcaatttgctatgaacgatcaggcggtacaaatcgccttctgggataaaagtcatactgattttgcggtcggggctttgtgggtgaggtgcgtcgcgtttcacgacatacctacaatggcggataattgcatcgcggggattgctgtaccccagcgcagcggccacatccgttccgctgaacaagtatttgccgttttcctcaatgacacggatactgccaaactccgggtttttgaaaatttccatctggttcatgtcgtgcctcctttggcatgataaaaggcggcctttaccagccgcctgcgtgcatatcgtgattgaccagtgaagtgtagtggttattcatggtggtaggcgcattgaatagcaccgcaagcaggtactgcttgatgttgcgtacctgggtggtgttcttttgcagacagtccatgacaaactcgatgtgagagctgtccaacttcaaaaagcgggagcgtacaatctcgtgaggaaagtccgcaccagagatccttgtggtctttcgtttggcacagaccgtttctaccaacagctctacgatctcattcaggtcatccaggtagagaggataacgccgcttcagacagtcatactcgatattctccaaaatcaactcccgataattttctatctctgtgacagacatcgcatcccttcctttccgttccggcggtcttgccgccgctgtttcccggaagggaatggaatcggtacttgatccataagtaattgttttttctgtatttgatttctctatatttaattctgcgggcttttccgtatccgggtttaccatatccgggttttccgtatctggtgaagccgtatccggctgggacatatctggctggggctgttcatagatgacatactcggtatctgtgatccgcccacttttatcgcgtctctgatggcgcacgatatatccggctccttccagttcacgcagggcagcaccgatggcatccacgccctccttacagatctttgcaaggccacgggtggtgtaattccagtcctctggcaaagacagcatcatggaaagcagccccttggcttttaacgacaggtttgcatttcgtaaatgatgattgctcatcacggtataatcacgggtccgttcaatgcgaaaaacggccatcgacctcactccttccgaattttgggtacaaaaaaccgcaatcctaatttcaaagaattgcggtgttcaacgcttttcaaatcttcttgcatagaaccaaaacagcggcttttggggacgcgcctctgtaaatggctcctcctgggcgaaaggaagtgtttgcatcacgcggtcaatatccgttgaatccatgtcatgctgagatctgcaatcttcccggattgcttcttgaatttcctttaccgtacacatagtcattcctttcctttcgttgtatgggtttatgagcggcggcgttttcccggtttgaaatcgaggatatgtccctcaatcacacgagcgtaacgcttgatcttgatctcccggcgctgctggctttgcagggcggcctgataaccgtcctcagtcaaaaacagccgcatttcatctccggggcttccgtaagcagtgctgggacgcagaacggaaaactcgatcatccagctggtattatcccaaaacctctctacggcgagaatgttgtgtcctttcagctcacgggctgaaatatccctcataggcggctcctttcatcgttcctggtctctctgacgctttttctgccatgcctccagcagcttgatgatggtttcctgcatccgctggggcgtatagcttttggggaaatacttccgcaaagtgtcagaggtaaatgtcactcggtccagatcacttttcttttcctcacccatgatgacacgcatcatatcgagggtcagatgcccctcctgactgtatttcttgagccgctgggcttgggaaagggaaggggtagcctgttcactgtccatcgcgtccagcagatctgtctgttcttcttttttgagaaaggacagctcataggcagggttcagggcaatcttcttttcatccaccatatccatcaattcaggaatcagctctgtcagacggatatagcgctgaatttgatttttactctgcccaacttgttcggccaaaatatctctggactttttaccgtccaacttgtgcccaacttgggcacaagttaaatcaactcgctccccctgatgtttcatggcatccagcttcattttataagcaaatgctctttcactggggagcaggctttctcgctgcaaattgctgtcaaccataatgatcgtagcggcatcatcatccaaatcccgaacaatgaccggcatggtctccttttctgccagttcactggctctgtgccgcctgtgtccggctaccagctcataaccgccctccgggtccggtcgggcaatggccggaaccagaacgccatactgcttgatactgtcagcggtctccatcatggcttcgtcatccttgactttgaatgggtggttcttaaacggatgcagttcagacagcggaatttcctgaatcttttccagctttgcatcctggcggccttcttcggtggaaaacagatcatctaccgaggccagctctatttttttcgcgctgcttttcaagtttcaacacctccttcgtcagatttttgtagccctctgccaccttgccgccgggatcatgggcaaaaatgctttttccctcggcgctgatttcctttgcccgaacagaatggggaatctctgtgccgaatactttgatcttgctgccataggtctcccgcaggagcgcggagatctctttggcaaagttggttcggctgtccaccatcgtcagcaggataccgtctatctggagcttggggttgatctgccgctttaccttgttcaccgtggagagcagttgttccagccctttggcgggcagatactctgcctgaacgggaattatgatcctgttcgcagcggccagcgcattgactgtgagcatccccagagagggctggcagtcgatgaggatatgggagtattgccccttcagcgtgtccagatattgccgcaagacagtctcacggctcatggcatttaccagagatacttccataccggataactggatgtccgcaggcatcaggtctacgccctcagggtggtgcaggataccctcgccgggacggagcggctcatccatcaggatgcgtcccatagcgtccgacagcgtaaagggcagcttgtccggctggggattgcccaagctgatcgtcaggcttccttgcgggtctccgtcgatcagcaagactttctttccagcctgcgccaaaccgattccaagattggcacaggtggtggttttgccaacgccgcccttctggttggcgatggcgatgatttgcgtgttcaaattaggttctccttccataaaaaatagccgctcatcaaatagatgaacagctgtctcagtgcataaaaaaagctgcctattcttccaaaataagcagctcgtcatatttatttagtttttactcccgaaaaggtcttacataagaaaaaagggtcctattttatggggttttgatgggttgttaccgtctgtcggctcatacgtgagccagaatgcctaagttaattattttcatgtgattttcctcctatcaacacccaaaaaagggcataaaaatacccagtgataaatactcctatcactgggtaaataactccaatagccccaaaacacttatatgttttcgggcatataaaattacatgataaaagtattcttaaactgggtacaaaaaactaagccccatattaaaagtgaaacgggactgctactttttgttcccactatcaaattgacagtttatttaagaataccttgccgcatatttattaactccttgtataatactgaatctaattatattccttaaccctttatttgtcaagctgacaaactaaagcagaaaaagcggcaggatttccccctgccactaatcatctgtttatgcaaaaataatttccttttccacaatctccctcgcacaagcccttatgttattgaggcatcctgtccattctaaggcgttttctgcctttagctgttccgttatgccctgtgcctgtttcataccctctatgagcctttcaaagcgttcctgtgcctgtctgttgatgtcggcaaggtaggcgtttagcctgccgcttgtaagaagattggtgtatgtaactttacggtactgttttagataatctaaatgccgttgcccccagatgcctattgcctgttcttcttcggcgggtacagttaagcacggtatcaaataatccccttgcctttcgtatttgccgcccagttcctcaaataatgattttgccattgtctgttacctccacattcttttttattttgaatgtccgcaaaatccgtcctacatcagaaggtctccaaggcacatccagatgatgcaatgcaatcagtctgtcctgcacattcgtaccggctcccattttggctgtggaacctaataaaaaacgaacctgtccgcttcttacctttgcaaacagctccgcttttctaagctctgtattggcatcatggataaatgcgatctcctgctccggcactcccttttccatgagcttattttttatatcctcatacacattgaaagtgccatcgcccttcggtgtggagaggtcgcagaagattaactgtgccgacttctgctctttggtgttctcccatatctcataggctttctccacacaggttgccgctttggaattttcctcatccggaagcatatcgttgagcagcctctggtcaagtgccagctttcttccgtcatttgtaatctttagcatattgtcctcgtaaggctgcacctgtctgtcccggactgcttcagcacgttccgcaagagaagccaccatttctttctgaaattcactcggctttaataccacattttcatactctgcttccggcacaggaagttttaacatatccggtgtctgaatgtccgcactctccttgaaaagtgcaatcagctccggaagattaaaaaacttcgcaaatcttgtctttgcccggtatccggttccctccggtgcaagttctatggcggtctgtgtttccccaaaagaagccgcccacgcatcgaaatgtcccagtcccagcttctgaagcgtaccatactggagataacgcatattcgtataaagctccgtcatgctgttggaaattggcgttccggtcgcaaaagttacacccttgccgcctgtgatttcatcaagatactggcacttggcaaacatatcggaggacttctgtgcttctgtctgtgcgatgcctgccacattcctcattttcgtataaaggaacaggttcttgtaattgtggctctcatccacaaacagcctgtctacacccaactgctcaaaagtcacgacattatccttacggctctggtcatttaacttgtcaagccgcacctgcaatgctttcctcgatttttccatctgcttaatggtataacgctccccgttgtctctttttgcctgatcaatagcaagctcaatctcatcaatctgtttttcgattgtggctgcctgtctttcctgtgataacgggattttttcaaactgactatgcccgataataacggcatcataatcacctgttgcaatacgggaacaaaatttcttacggttggcgggttcaaaatcctttttcgttgccgcaaggatatttgctcctggatataaccgtaagaaatcacttgcccattgttcagtcaggtggttcggcaccacgaataatgacttttggcatagtcccagacgcttgctttccattgccgccgctgtcatttcaaaggtctttccggcaccaacgcagtgtgcaagcagggtattatccccatacagcacatgggcaaccgcatttttctgatgcgactttaattcaatatccggtgtcatacccggaaatttcagatgtgaaccgtcatattctcttggtctggtggaattgaaaagctcattatattttgccacaagtgtctgcctgcgctccggatcacggaatacccagtccttaaatgcttcccttatcgcttcctgcttctggcttgcaatcatggtttcctttttattaagaactcttttttcctttccatcttcctcaatggtatcataaactcttgtgtctttcagatttaaggaatcttccagtatcttataggcatttacccggcttgtaccataggtcatgttgacaagcgtatttccaaaatcagcgtttttccctttaatgttccactccccggtcacacccgaaaactgcaccccaatcgtatctctgcggaataaatgctccggtgtctggaacgtatcacgcatgaaatcattgatatattttggatcaatccatgtggcaccaatacgcacctcaatctccgatgcgtccagctccctcggctgtacctgcgtaagagcctgcacatttggagcatattccggatgattttccgcataagtggctgctatggcaagtttctcacgcacattgccgctgagatactggtctgctgtctcccacacatccgtaagcggattctggaaaataacaccacgaagttcctcggtaagtgtatccttatctcttccggtaagctctcccatataatcaaggtcgattttggctttctctgctaaagatactgccagcgcttcacttgcggtatccacacttgtgacaacctctgcccttttaatggtacgcttcgtgaacatatccgccttgcctttgaaattgccctcatcatcaagtttttccaaagaacacaacaggcaataactgctgtcctgattaaaggctctcttattcgtctgtgaattgatcagaccatatttcttagagaaattatcatacaggctattaagttctgtctgcttttccttaattgttacatcggagtattcctcaagctgcatatcaatcagttcctgcgtacagttacggattgccaccattcccttgatacgttcttttgcggtgtctgatacttccaccggcttcatgacagagttttcacggtaatatacctcattatcgactacggtataactgaaattcttgacggacggatcagcaggaatactctgcctgctcatttcatccgcaagctcctcatccagatcaatcgtatcaatctgtcctgtaatgttttgaagtgctttcgctaactgctccgcaaaaggtctgctgtcatctgccctgcaggtgctttccatgccatagggaccggataacatttccatctttcctacgatctgctccggatgctctgcaaagtaagcgttcattgcaatgccatttgcatcttctcccagatgtacccagtccggctcacgctccaccatgcggtcacgcttctggaaaaataatatatccgaagtgacctcggttcccgcattcgccttaaatgcggtgtttggaagtcggactgcaccaagcaggtctgcccgctgtgcaaggtatcttctgacctccggacttgccttatccatggttcccttgcttgtgataaaagcaaccacaccaccgggacgcactttatccaacgtctttgcaaagaaataatcatggatcaggaaattgtttttatcatactgcttatctgccaccttatactgaccaaaaggaacatttccgattgccacatcaaagaaatcattcggataatcggtcttttcaaagcctttgatctgtacatctgcctgcggataaagctgttttgcaatccgtccggtaatgctgtcaagctccactccgtacagcctgctttctttcatggaatccggcatcataccgaaaaagttgccgatacccatggaaggctccagtacatttcctttggaaaatcccattttctccaatgtttcgtacatctggcggataataaccggacttgtataatgggcattcaaggtactctcccttgccatgcggtactcctccggcgatagcagttcctttaactggtgatattctgctgaccagtttgatttgctctcgtcaaacgcatcggcaagaccgccccagccgacatactgggataaaatctgctgttcttccggtgtagcatatctgttttcgccctcaatctgctccaacagcttgattgctgcaatatttgtctggaatttttcttttggagagccttcacccaatcggtcatcgctgatatggaaattgacagcgttacttttatctggtgctgataccgacctttcttgtgctgattgcctttctgatgcaggctgtttttcctctgacgaaggtgtaagcggctcacaatctccggtaagcacctgcgacaacatttcctctgtctgtcggtctgcttctccattctccagacgctcacgggcagactgcgtatctatgctgtccagttcatcggcttcctgctcagcctgttccctttcaccagaaaactccgcctctgcttccatgccactttctgcaagttcattgccccagtccattgcttcctgcaaagtcgaaaatgtctccaatgccggacgggtaatgtctgccgtatcataaatcgcatatccatccgcttccttatcaatccaaaggaatactccctctgataaggtggcactccattgtgtcggattgccatattcatcatctgcatcatgtaccacatgccatgataatttctgcgatttctcttgtgaaaattcttgttgtggctcagtttcatccggctctgcgataccatccgtcccctcaaagcgtgaaaacacttctgcttcgtgcctgtcaatatcttcctctgcaatggcattgatataatcgtcctctacctcgctacgctccggcttatggtcgtattcaaaggttttcccattgacctgtgcataataaaaactgctgtcctctatgttatttccaagcaggtatttctctttttcactgccccactcatcaaccagaacacactcatatccatcaatcgtgattttttgctgtgcttccttttctttttcccgaagcacattgatatatcttctcgcctgattggtaaatccgtccaataccgccggatgtgagcttagaatcagatcattgttctgccactcattttccgcaacaatgccctttgcccagtccttattgttctgcgaaaaacgaccgtcataatcaaaatgcgtaaccgtatttgcaagaacaaattccacacagtcaatgccatatttatctatgatctcatctgcggtattcctcggaagaacaaaaccattgaatttctcagcaatcagtgcatcaatgtctttcttacactctaaccgctgtccatgctccagacgagaaagctcacgctgtcttgctttttctgcctgttcttccttgtaagccttatagttttcctttccctgtggagataagtatttgtcctctttgatcagctcacgaagccttttctctacaacattccagttcagaagcacttttgcatacggattgccataactgcctttctccagacggataccttttccatcatgttcattatgggaatcatcattacccggcagtccgccggaaccaccaccaatgccatattcatttttcagaaaagcaactgtttctttctggtcatgtccttccatgaaatactcataaatgcggaaagctccatgctcatagccgcttcctctgccaagtgcatagtcgatttcatcctgtgtgataaaatcttcctgtgctacctccaccgcatccggcaatggaaattccagtctctccctgtcaaggtctgctatctccgataacagatattccggtgatttcacatgccgccattttaattctgcttctccagaagcaaggcggtttgccgcatcttccaaaatatttttaagctgttccctgccctcatgggtggaaagaaactccatgagttttgcttcactttccggataatttcctgcttttaagccaagctcctccggcatttcatccatgccatcccgcagaaagaaatagatctggttggcaacacgatttctctcctgtgtatccacaagaaatgcttcactggcactcatataagtaccattttcgatcatagaacggatatggctctccacatcttcccaatccatcgtaacaatcggtgtttcccttgcctgtgttccatagccgacactcatgccatgctcatcgaaccacaccgataccggattcccattgatttcaaagccttttccggtctgaccgtattcatttttcagaaaatcaaccatctgctcggcatttctgccctctgtatactttgcaaaaatacgcttcctgctgtgctgttttcctccgccactccttaaaatggtttcaagctcattctgtggcaaagaaaaagcagcgggcatggtatatttcatacttgcttccgctgctgcgactgttccgacctgctcctcaaaagaaggaaacatgctgagttgtgtaaaggtagattccggtgcttctccccggagaagatcatctgtgtctgttacagactgtaaaccagttctcccagaaccacttcctctgctcggttccgaatgctgttcatcttcgctacccaaagcatctgatcggtttccttgagctgttctgtcactccctcggttgccgccatctggcttgtcagcttctccattctctcctctgcctgcttctgaatggtcagcaggtgttctttcaatgtccctttcagaagaaacgctgagtacacgcccctgtggttctccttcagataagtctctctcatcattccgtacttcgttacggttccctccggctgaatgtccgcctgtaatgtcggtatcagataatccccgttcttttcgtatgtcagcttcatcgctattgcccctttctacgctgtttggattgttgtcactatattcctcatgtccgcttttgctttcacgctttaacgcattgtagtctatttcagaagtatttgcaagtcctttctgcgttaaattttctgtttgttcctgttcgtggcttctgttatatgcccttatggttcttccaatctctaaaagtaccggttttgcaagctcattggctgcatctccaagtactgcaagggtgtccatggaattaaattcatggataaaatcgaaagaaaactccgaaccatactcctccatatctgcgccacaggcagataaaagtgtaaaagaaatactctccgataaagtatctcttaaacggataccgacattttgctcatccagtccgtcaaggaaactgccctcgatcatgtactgcagatccggcagcaattcctcataataatctgccgcaatcctctcagctatctccataagtctttcttcaaacagcttcttgtcatctgtggcaccataggtctgctctagacgcttgatgacatcttccttatgttcctcatgtaattcccagagttccggataccgtccgattctccttgccgcatggacatcagaaacatcaaaaacatatttcaggcgctttccatgtgcatcatcctcatccaaaagtgcaataccctttgcacctttgtttacccagcaatgcatccgctcattccacagctctatggaagcacacgctgttgcatccggtctttgtgcatagattaaaagctgttcccggaacggatacttatataatctcgccgctgtagtaaggtatttcatccattcctcacgatttttgacaacctcggctgctgtctcctttgctagagccgatataaaatcatattttctcacgcagttctccttcctgtcatagatacgacaaaaaggcagccacatacactacatgactgcctttcctttatttcccgttacattcctattctgttgtaccaaagctgaaagtcttactctcagccgttttcttaggcgtaaaccttgccttaatttccgcaaccctcccctctaatgcctgaaacatcacatctacctgttcctgtgtatattcgtaggaacctcgatttgcaagattctccagtctgccaatagcatcaaccgccttattcatgcggtactcgccaatacggataaacttctccgcctttgtctcattttcctttgctgcaggttcaccctgcatttcctctgctgtcattgttgcatttgtttcttccatgtgtttttcctccattttttgacaaaaaattagagcgtatagtttcccatacgctctgacgctgtgttgttattagttgtgtgtgatactagcattgcctcggcaaaccagaatctatcaagacatcgattatcttatccacctaaatataaataaaaaattataacagggaattgctgtacgcttcttcaaaaatatcattatataaaaaaatattttctggatatccaataagttgataaaagaaagattctgggaaaaagtcttgtgtactaagtatatttccaaactttccttccattccttcttctgctaacatttctttaacgatttttatagtatctgaataaatatgtgttgaccgtaactttccaatacatctttctaattgaaattcaattattctcggctttcctttactatttgtatcatgcatccacttattaaaactttttgattcagccattaattcatgtatggcatttgtcgcaactacaccacaccatgcgtcacttaatgtcctatattgtctatttttatgttgagcctcaacaatatacgtaaacaatcttgtcattaaaatcaagtttctatgcgcatttactggaataaatgttcctaaaactgaaatagctccattacgaataaacatatctgctatgttaacagcccccattcctcttggactagaatgacacgcacttaatatcactattggaggtaccataatatcctcagaagccatccaaaattcttcaccaaccattattccagccatattctttttgatattataatatccatgagctgaaatgtataatatatctgcatcctgattgttcttaataaatttaagtatactttcaacgctataagtttgttgataaataactgaaaaaccatcatatttttttgtcatatcaatcaaagtactacgcaccaaatcactcatttgatatacatatttgttctcatcattattgataatgcattccgctatagcaactttacattttttccctaaatagacttggttttttttaagtaattccaattgcaattgtctagttaatggggtcaacggtctataagaaatatttttataacattgcaatgggacttcatcattttctaaaattgctaatcctattggaaaatcagaaaatatagtaatatcttttgctctttttagcacttctatttgaaaactattaaaacaacaacccagtaactttcctaaatcgctaaatgtcttccaaatatatttgttatttgttccatccttacatctttgttcaagctctccatattttttatacagttcttcttttacacatgataattccattaaaattccaccacgtgcaattgctctatgcactcccattatcctaatagctcgtttttcattttcagataaaatactagcagataaaccatactttttttgtgatttaggaatgccagggaaagttatcacaacactaatatcaaatttatacatttgcttaacaatttcatcatcatatactttattagccttatcatcccaacaagttatgcctttttttttcattgaaatcaaggtgttaaggtgcgatatgtttttccattgcatgtcaatacactttttctctacctcactacaattgaatatttctaacaataaattatttgtttctccaaattgtcgactaagataaagcgccggtaatgcttttagtttttctccttctaacctaaagtgaatgttaatatccttaactgcatcaaattcaaaatcattttttcttttaagcaaccaaattttttcccattgctttttgatcaattcctggtttaactcatgagtatagtatgttcctaacaatggatttcttttctcacagttactttttatatctttactgcaatcttcagttaatataaatatggtgggggcaatgttatctatattttgattaacaagtatataatctggaacaagaacaatttgatgcggtgtatcatatgataatgccataaattcttcatctaaatcatatatatcaaatacattcctaggcaaatgcattatatactctattgcacctaatgttccattcaaatcatcatctaacaaatgcattgtcccattattattcttttttatggattctgaatttccaaataaaactataggtccgctaaaaccattgtcattacttttgaatactataaaatatgtaaaataatattccatgtatatcctccatgtttctatactgcaaatgtcgcaaagttcaatttatctttacaaaactatatcacaataacagttacattcctacccctgctttcccttcgtctgtggaaattccatcttaaatttatactgaaaccccttgatttctttaccatctttcgtataggaaaattcctctacactctctggaatcaggtacgcatcataactgcccttctttcctttcagaccttttacaagtatcttttttccttgaagtaggctcctgacctgagaatctgaaagtgttaccccaaatgccttgccaacattcatgccacatttcccggtacagtacgctccaaattttcccttgactacatcagcaccacatttcgggcatttacctagcacttcctgttcacccttgcctgtgccaaacatggctttctgctcatcactaacgctgtgataggtctttacaagatcagttaccattgcttcaataccagacataaactgctctgcagcaacttctcctttggatacaagtgtaagctcattttcccagtcagcagtcagtttcggagattttactacatccggaagtatcgtgatcagcttcattccgtcctctgtcggaatcatctgctttttctcacgctttacgaatccgtcttttaccagtttttcaataatgtcagctctggtggcaggtgtgccaagtccttttctctccacttcatcgcccatatcctctgctccggctctctccatggcggacagcaggctgtcctcagtgtaatgttttggcggctgtgtgaaatgctcggaaacctttgtctgctccactgcaatcatcatgccctcacgaagctccggcagcttcttttcttcctctgcatccgatttatcctctgcggttttataggaatttttgaagaaatcctcaaattccttccatccatttttccacacttccttgccagataccttaaatacagtattgttgcaggtaatcactgcctttgtggaattataaatgtgcttctcccaggtcgcacacagcagacggtttgcacaaagggaaagtatcttcatttcgctctccgggattgcctttaagtcctgcttgatgatctccatggtaggaatgattgcgtggtggtccgtcactttcttgctgttcaaaattcttttaatatctggattgaacatgatattctgttcaaataacagagaattgaaaatcgcttcgatcacattttttgcagtaccttccatgtcatcggaaagatactggctgtctgttcttggataagtcactaactttttctcataaaggctctgcgtatattccaatgtctgcttggcagtaaagccaaacagacggtttgcatccctctggagtgtggtaaggtcatagagtttcggtggtgccacccacttttcttcctttatcacagaagtgacaagagcctgtccgttttcacaggctcctgcaatcctctctgcttccgttttatcactgatatgctctgataccgcatccagaccatttccaatgatgtgagccatataataggcttctttcttgaaattcatgattttactttcacgatccaccagcatggcaagtgtcggtgtctgcactctgccaaccttcaatgccttaccgccatataataccgtaaaaagtcttgtcccattgatacccacaagccagtctgcttcctgcctgcataatgctgaatgatacaagttatcatagtcgctgcctggacgaagattatggaagccgtcacggatagcgctctcctccatggaagaaatccataaccgcttcatcggttttctgcaccctgccatgttgtaggtcaggcggaaaatcaattctccctcccttccggcatcggttgcacacacaacagcatctaccctgtcatcatgcatgagctttttcaaaatctgatactgtgcttttgtatcacttttcacttcatgctgccattcctgcggaatgattggaaggctctcatagctccatttcttccatgcttcctcatagctttccggctgtgccagttctaccagatgtcccacacaccatgataccagatactcattgccttccaaatatccgtccttacgctgtgtggcaccaagaactgccgcaatgctctgtgccacactcggcttctctgcaattacaagctccatctctattcctccccattttcttcatcattctcgttgttgttatcttcattgtcattctcgtctgtgtctactgattctgtatcatctccaccatttatgaatgcttcgtcgaaatcctgctcggtttcttcctcgtcatcataatcgtagtcctcgtcaagctcgtcctcatcttcatcctcatcaatgaagttttcctttttcttcttggatttcacaacatataccactccgatcacagctaccgcagcaatgcccattaaaatatatgtaaagccggaaccatctgcttttgcggtatcctctttcggctcacttgtatcctccgtgctatcttcggtgctgtcctcaacactttctgttccctgtgttttctctcctgtggtatcagcattattgtttgataatgcgctgtctttggtagggattgcagattccaatgccgctgaatttttcggaagtgtctcgctgttatccgttgtggtattcagcaggtcgttttcactgacttctgtaaggaaatacaccttttcatcttccccatcacgatcaattaccagataaaatactttctcggatgcagtctggattgtgtaaaattccttgcctttttctgtggtctggctgtcactgctctggtctgcatccttggaagtatctcccgtacttggagattgctttgctgttgcggaactgctggaagttgttccactgcctgtctgggaaactgtatttccattcacatccgttttcgtatgctctgtgacctgtgcggttgcagagtttggcttggttgcagacgcatccaccggaagctgctgtgccggatctttttcattgctgtccttattctccggatcggtgtaatacggattggctgttttatagatttcagaggtatttcctgcattatccatggcagaaatcgtgaaatactgataccctgcatcgaactgttgcagacggatattcaaggctccattcgtatggtcggtaaattcatatccattgacatagattgccttgataccggaatccgtatcatgtgcctgaatgctcaaaagaccgtcgctgactaccgcatttaaggtaggctttgtaaaatcaaagcacttgatgtagcggtttttctcgtaggtcttgcccttctggtctgtgacctgcacataaatggtgctgttctcggaaatctctatgtgcatatcctcggtaatgtccgtccagcttccattctgtccgacttttgcctttactgtctgaatggtaaaattaccggaaactatcgtatcttccaccttgactgttactttcgtggtatcgttatgccacccagaaggtgtattgattgtaatttttacgctcggattgatataagcacattccttgtaatcctttgcacacacctcacaatcctcatccaccgcatactgactgcatttttccttgcaggtgcattttgcggcaggctgtgtctcctcagttgtgccttctgtggaattttccgttgcattctctgtggactgctctgtgtgattttctccactaccggaactgtccttgttatcattaccggacgctgtgctttctgcactgctttcctctgccgcactttctgttttctgctctgcggtatcctctgcatgaacctccacagtatttgccctgtttgcaaaaaatgccccgaccggcatacaaaaaagtattgccgacagtatcagggacattagtgccttaacggataacttcttcattttcattggtcgaatcctccttttcctgttcccgtttctgtaataaatttctgacttcatcctcactgagcttattaagcatctgcaatcgctcggatgagattttatattttcgtatgatcttcatggcttcggcatcctccgccatctgtttctgttctgcaaggtctttttcctttgcctgtagctgtgctatctgctctctgacctttttaagctgtgaattgattcgttctactgacaaaaataattcctcccttcgctaattcaatcttccaaaaccatagaaatggctctgccagtaagaagtattgattgatgtgtactgaattggatcaccgcaatgcaccatcgtaccgtttccacagtagataccaacgtgtgtaaccggacgtcccgcattataagttccggtaaaaaagataatatcccctgcctttgcgtctgccgctgataccggagtacactggtcataaatgccctgtgcggtggttcttggcaggttatgtacgccgctgtttgtaaatacccaacatacaaagcctgaacaatcaaaacttgccggagctgttcctccaaaggtgtatggcattcccagatatctgtttgcttcccgcataagcgtctgcaccgttgcatcgtcataggactccggtggtatcacattgccggttcctcctccggtgccgcccgttgtttccccataaatggtctgttctcctgcttcaaaataaaataacgggttataatacaccccgttatacagacattcaatatgaaggtggcttccggtactgcttcctgtatttccgcttttgcctatattgtcacccttttttatactctgccctgcggatacatttaagctgtccatgtgggcatattttgtgctatatcccttgctgtccgtaatcaccacataattcccatagtatgaatcgtaagccgcttccgtaaccgttccgtcatgggctgcatacacgagcgttcctgtcggtactgctatgtccacacccctgtgaagctcctcagctccggtgtttggatttttccggtatccgtaataactgctgatatagtaataccagtaataatcaaccggagaagcaaagacctgtaagccgccttttgtctccgtataggctccaaaaatttccgtctgctcactgtccatgcgtccggctacaatgctctcaagcggtgtgaccgtaagtgtgacacgaagaattgttacggtatattcttcttcctcctcgtactcatattcctcggtatgggtagtcccgtccggatttgttactgttctggttccggtctttgtgactgtccttgtccgtgtctcctccacttcctcagtagtaagggaatacatggcatcaaataattcctgaatctcactctccatcccctcggcagtaaattccgtatggactgcggaaagataactgatcagtgtatatggatcatgcccgattgcaccaaggttataatcgtattcatcatatcccggataatcagtttcaatccggtcaatcttgttttgcagctccatttccttttctgtaaaagataaatctgctgcatcaatctctgccggaaggctaagatatgtgcttgccatcgttgttgtcacagttccggtaaacatggaaccgcagcttgataatgccgacatgatcataataagcagaagagcaaaaatacccactgtgataatcagtgttttattttttgtggcaatctcctgtaacttctttgcaatgccggttgcagcattggctgtctttgtaaatgtttcctttgcagtcttggcttctgctcctgcccgccttgccttggcatactcacgcttgatacgctgtttctgtagctgcctttgcaactgcttctttggactgttgccctttagatgtggattttcactgatgaatttctcatactccagcttcatatccgctgtgacctgttttttctgcaatcgctctaatcggtcacgctttctctgtgccttgctcttgcggtgatatttcatgtaatggtaaacatcttctgcacgctgttctgtcttatgtgcaccctccacagcagaattatccttttctgtctctgcaatctttcgatgcacaaaatacatattttcggtctggagtttgtgaaccgcagcttttccaagtccgtcaggcttgaatggcttctccacttccaccggaaccaccacatactttgcttttccggtctgttcatcaaagacacgtttcatctcatactgccgctttttcggcatcttgtcctttgctttctgtaacttctgacgactcttttccgacttatcaaaagccttctgtacttttttgtcggtaaattcttccgcctgtccctgcgaaaatgtggcatcctttgtctggaaatctccataatcggactgctttgtattttctgacttcgcacgctctctgtgtgcgtgttccctctgcacacgccctttgtgatattttcctttttcctcagaccgttggtaggtatttctaacgtggtaattgtcctgaaaactgtctgcgtcctctgtatggaaatttgtagcattaccgttttcctcattgataaagctgttttcctttaagaatgtcttttccgcttcggcttccgacttctggacattgtgaccagaagtgtcctgttgttgctgtcggtaatattttttcttattatttttcctgtattctgtcccagtattaaactctgacttctggacgctgtgaccagaagttgcttttcctgtacgactgccatggttcgcatcccttggcagattgctcacaggcttctcgctggcactaaactggttttccacagaaaaggtgttgtcctgcctgtgttctatatgttttactccagtcacttccttatccttggaaaatgtctctttttcaaatgcctttactgcctgcttcttctgtcttttttctgccattttatactgcgtcctccttctgcaccgattcctccggcttggtattcataattctgtaagtcttggtgtctgtcggatatttgtctacaaatggaattaccacattgtcaaacagtatcagaccacttcccggctcggagttggtgacataggaaagctgcttatcagaaagtcccagcttatcagcgagaattgcctgatctttggcattctgatttaacagatacacaaaatcgctgttacccaaaataccttcaatctcctcagaacgaagaaaatcgcccacgttctgcgtcaaaccagtcggaataccgccccattttctgaaacgcttccagatttccacggaataaatagctgtctgcttctccttcagaagaaggtggaactcatcacagtaataacgggtagcaatctttcgctccctgttctgcgataccctgttccaaaccgcatcctgcacgattaacatacccagctctttcaactggtttcccaaatctctgatgtcaaagcacatgatacgattgccgctgtctacgttggtatggtggttgaagtaattctgggaaccatgcacatacagcacaaggctgtttgcgatacgctccgcctttggatttttgtgtgctaacagggcatcatataaatcttccagcagcggcatattttccggcaccggattttcaaaatacttgtcataaatatgacggatacattcgtcgatgatacctttctcatcgttctccagaccgtccttgccacctgcgatcaggtcacataatgttatgataaaatcagatttcagttttaatgcttccttatcccccttatggctcaattgaatatccatagggttcagatagtctttggaattggtggcaagttttaccacctgtccatgtagtgctgccacaagagcaaaatactctccctccggatcgcagatgataatatcgtcctttgtgataagaaaacagcttaaaatctcacgctttgcactaaaactcttaccacttccgggagtacctaagataactccgtttggtgtacggagcctttttctgtctgccataatcatgttgttgctaagtgcatttaatccgtaatagattgccggtgcaggcataaataactcctgtgtgcagaatggtactaagattgcggtgctttttgtggaaagagtacgctcaatgcctgtctcattgcatccaatcggtgcggatgccataagtccctgttcctgcaaatactgtaaacatctgaggtcacagtttgcctgctgaatgataccggacaccctctgcattaagctctccagttcccgcttggttctgccataacaggtaataaggaatgtcatgttgatcatcttctggttgctcgtattcaaatcatcgagaaattccagcgtgtccttttcataagtcacgatgtctgttggaagaatatccatatcgtagccgcttcggactgcctttttctgttcctcaatcttcattttctggatattggaaataaccacttttaacttcttgattgcctttaccggatcttccgtctgcatgtgcatggaaatcgtaagattagcatcaatatcaagaagctgcttgatcagctcgtccgtaaacttcggtgcgataatatccagataggacacacagccatacatattccctgacttaaagcggttcggatagcggaaatcaaatcccggcggtgcaatatagtccttgaccgacttaccggattctgccaaatccttaaatgaaaaacggaaaggctccatcgtatcctgattaaaatattcatgcaggatgcgcagtctttcctttccgtccagtcccctcgcaagggttcctatgttgtttaagttccgtatgacatctttttcaatgttgttaaggcggctcttggcttccttgtagccgttgctttctacaccaaaaatcagatattttgatttgatgataccgttgttgccctttgccgcctgcttctttaacatttccgtatattcctcacgaatatcgttaaaatcatcctcctgccacggaatgtcaaactgttctgtaagcatctgctcgttgacctgcctgttgaaaagcaccagttcaaacttcacagacggatcaaaataattgataagcttgctgtactgtgccagtatgtccgcttggtcatccacttccagaagctcatagtttatatcaaaaaattccaccatctttgtataataacggtggctgacctgacagataccgtcccggaacatcttttcaaaagtgatcgtcctttgtgcggtagtcggcttttctttctcaatactctttcccgataaaatatgctttaactgtataagacgcttcttttctgaaaaggtaagaccgccacttttactgttgttcctgctattgcctttataactgctttttctgcggctttccggttctgccttttgctttttcttcaagataacgaacctcccttcgtaatttttctttttcttccaactgcttgtataaattttccgaccggtatggtcttatgcccggtgtgagtatcttctgccggagcataaaatacaaaatcttctccgccggaaacccgtttttctcatacattgcaaaaaagaaaaatggaagcattgctcccatcataagaagtgatgcggcagatgttccgatcaatcccttggttaaaaaatacaagggtatcccggctactgccgcaccgctgaaacagatgatctgtctctttgtcaagttcagtgccacttttgtcttgataccggacaaatcctttggcacctgcacggatattgccatttcgttcctcctttaatgtgcattccagatagatttagacagggagcctgtcttaaaaagtgaaaaacataggataacggtatatgccgccactgaccagagtgcggtatgcaggttgtcggctactgccacacctgccaccagcaccgcatagatagcaacgcacaccatcataaaaaagccctgaaatgccaatgcacaaagtcccttaaaataattagttcctatcgttccccattcccgattggttacggttgcacagggaacaggtgctactgatacataaagatatatttcaatcattcgcccataaagaatgacggtaatcaggactgacatgattttcatacataaactgacgatcatggtctccattccaagtcccaacagctctcctatgctcatttccgaaaactgctcattgaacatcgtctgcagcgtacttgaaacatcaatactggtttccccgctgattgctgcggcggcagaattgacgatgtggcttcccacatcaaataccgccattacaatgtcaaaagtcttgctaagaagcatgactgcaatacacgctttcataaaaaaacggataaaaattgccgtattgaagtcatgcagattattcttgtcaataaccatggaaataagctcatagacgagtacaaaactgatgatcattcccgctatgggaatcatcacgttatcggacagggtttttatcatgtcaaaaataccggagttccaagtgctgggagttttactgacctcccctgcaatcgtgcctaccttgtcattaacatcggtaaacatggtttcaaagttggtcagaacccacccctgcaacagttcctttatgaattcagtaatcttatcaatgatcccacccatgaattatgaaaacagagtggtaagctgtggaattaccgtctgtgccacaatgatgatgccaccgccactcataagctgttttatccccaattaggtgtaaaactctgctcgatggcgggcggcggcgtacaaaaaatctatatggtgtttttaagagaaccgtcccggcgggacaggtcaggcagtgacctgttccacctccgggatgggtttgagattaatcattataaactcttggtctttcttttttcgggactattcttttttcacagcccccacttgctgagtaaaacgtaacgctaatatacaaatacaacgttaccatgtccggattttcggtttcagactattgtaatgtatcatatttttaatacttaccggatttttataaagtttcatcaaaaaaccgaagcatatgctcactccatgctttggctgaagtaccatatcctaacccgatgccgtgatctcccgtcggaaaagtctcacacagatgcttcactcctgctttcgtaagtgctgcgtccaaccgagtcgtattgctggccggaacacagccgtcatcgagattcgcataagcgtatgttggcggatagccggtcagatcgtgaagttctaccgacagttttttctgaagatccgggtttccacctgtattacagcggcagcttccctcatgatattccgaggtaaaactgatcaccgggtacaacagtcctaccccgtccggccgcgcagaaatccttccatatagtttttccagctccggatgcgcacaaaaaatttctgttttcagttcttcatgcagcattgccgtgcttgcgcacaaatgcccaccggcagaagctcccaccacaagaatacgattttcgtcaatgccatactgccgtgcatgtgcacgtacatgcatcacagccagtgccaaatccatctgacactgcggataggtattgggctggatgcgatagcttaaaataaaacatatagtttcactccctgccaaaaaccatatcataaatcacatccgtaatttcagaattgtccggcaaaatacctgttataaaaagtcacgcagcatacgttttctgctcggtgcaccaagtttacgcagtgcctttgcctcaatctgacggatacgctctcttgtcacatgaaacatctgtcccacttcttccagcgtgtgcggctgatttccgtcaagaccgaaccgcagtgtgatcacttcctgctcacgatccgtcaggtctttcatggcaagtgaaatctgcttattacgcatctccgcaatcgcattctcctccggggataacgcattggaatcctgcacaaaatcacccagatgggaatcgtcctcatcccctaccggagcctccatggaaaccggatcctgactaaaactcatgatctccgttacacgatcttcatcttcgccaagcatctccgcaatttccttattggaaggttctcttcccagctcctgtgtcagagtacggcgtgcacggacaaccttattgattgtctccaccatatgtaccggaacacggatcgtctttgcctgatctgcaattgcacgggtaattgcctgacgaatccaccatgtcgcatatgtggaaaacttaaatcctttttcgtactcaaacttatcgactgctttcatcaggccgatattcccctcctgaatcagatccagaagcggcaatcccctgccgacatacttcttggcaatacttactaccagtctgagattggcttcaatcagttccttcttggcttccggatcaccctcactgatccgcttggcaatcttttgctcttcttccatggtaagcagacgcacctgtccgatcgtctttaaatactgacgtaccggatccgtgatatccgccccctccataaccgagagatcttcctcgatattttcctcggaatcttcctcaatatcatcatcaatatccaaaagaatcttactttcttccagttcttcgtcatccacctcatccggttctttctcctttgcagacaaagaaaccgtctgctccatgtcattttttgagcgaaggacttcgatcttgttatcttctaaaacttttaaaatgttgtcaaactgctcagaggaaatctctacccctgaaaatgtatccaggattttgctgtatgcgatcttatcctgattctttttgccctgttcgatcaggcctgctaccatttgaataatagaacgtttatcttctgtcacgaaaaatactccttatcaataaattcccctattttattttatatcttcttttaggttctaaaacattttaccacaattcaaaaataattccacaccttttttcgtatttatgttcattatttgatactgccgtttattctcccccgtgctctgctcctgcattgccttgttatttccggctctttcgtcctgctggtgacagccgatccccctcatgtatctctgataccctgtcaatgccctgtctctcataactccggtgggcggtgtcgtttggaatgtccggattgtatacaggctttccatacttccgtattactattgttatttattgtgacaaatattttgtctgaatacttatcgccaaccctgtttgattcaatttccgattttggaatagccttctttcatacgctccatagtttgccccattggcagctttcctgaagaagtgatttccaatcggttgtcatataccacaacctgtatcgtaccatgatccagataacgatatttgatggtattgaatcaaaaatattatgtctcactttattctcttctttacaggcactttctcggcatattcctgttccagttcctccgccagatacgcatcgctcatgcagtgcatatcggaaacaccatcacggatcagctgataaaccagtgaatgataaaagaaatccaaagccgcatccagtgaaagtccctgctgtttagcaaagcattcaataacacggctatattttttctgaagcaaaatcggattcgctgtcatagtgtttcactcccttcaaaacgcagcagagacagtgctttctctgtgcggaaacatatttgcaggttcggcttttcataacgcaggcggctgatagcttccgttttatcaatcagtccgtcaaagaacagctccaccgtattgaacaccttatcattggcaacaccgcctacaacaaggtcataatccgtcaaatcttttccactgcggcagttcagaataaaatccagccattcttcggaataagaatcgaatttcagcgtttttagttcagcttcccggctttcatcgtattcatacctggagataataccatttttcccacggtgtttgaacttgccgcaccacttcgctgcctgttcatacaacggtgtgacataaaagccacgcccgaagtctacgttagggcgggaatgaaccaaatccggcttagcaatctctaagaaagaaccatgatagagaatcatacttccacgcccctttctttcatcacatcaagaagatcattaacgatatattcccggctctgggtatgcagcacttcatattccggcacgatataaccgttcagaatgttgcttttttcagtaaatgcctgatacacacgctctgcatccacacccagctttgccgctacattttcaatgcaaaacacggcaaactccaactctctggaatttttgattttttcatccgccatcacgtgtcaacctttcctatatttttaataattcatagacttttttaaaaattcaacctttgttctatttccttatctgcacaataaaatcaaaataatcttttccaattttagtttcgacatctggataacctgatgtatcaactatccaatgattttatgggctttccttatattgtatttaatttaaaattatttattgttatttacagttttttgcttttattttgctaacgcggtcaaattgcggtcaaacttctaattcatttaatttcttcatgtactctgccttctctttataccctctgatttcatttgcaccaagttgtaatgctctgcgaatatactcttcatcattttcatcagacgcatgtttacaccttctagtatgattctgctgcagttttgaagaacatggatacaattcaactacagtataccatcaaaacaagacgatttctattatatctacattttccaccaaatgattcacaataaaattgtacttatcaatagaaaccaatcgcggaatactgccaacttctcgagacagttttgtcctatttaaaatatctacataagatacgataaaatacagaccatggaacaattgtgttgcagggtggctgacctctattttattttacatagaatgggggtggtgctgatgaacaagagatttgattttaaagacctcatgacctttggtctgttcattcttgcattactgacattcgtatttacgtttatcagatagtgttttaaagcatagaaaaaccaccccaactttgaccgagtaccagggtggatttttctaaccaatttgtgaggtcaaccacttgtgggcaattgttcctcttttatttacattaactataacacgacacgttccaaaaaacaagtagcattatttatatcatatgatagttatcatatgatagccctaaaatcacagaaggcaagctcataatcaaacaaaattatcctaaccgttacaataaaacgcttaagggtgtctgtattccagacaccctctttttatatctaaatccggcgggaaatttgcgtcctaccgtttgtgtcctacgtggcaaaatttaaggctaccgtggaacattgtaaaccacgatagcccttgattttactgtgtttcttagaacttaccagcctttgcagcttcctcaacagatactgcaacagcaacagtagcaccaaccattgggttattacccattccgatcagacccatcatctcaacgtgagccggtacggaagaagatccagcgaactgtgcatcagagtgcatacgtcccatagtatctgtcataccataagaagcaggacctgctgccatgttatctgggtgaagtgtacgtcctgtaccaccgccggatgctacggagaagtacttcttaccctgctcgatacattccttcttgtatgtacctgcaaccggatgctggaaacgtgttgggtttgtagagttaccagtgatggaaacacctacgttctcatgatgcatgattgcaacaccttcctgaacatcatcagcaccgtaacattttacagttgcgcgaagtccgttagagtatgctttctcatatacgatgttaagctttgcagccttgtaatcatactttgtctctacgaatgtaaatccgttgatacgggaaatgatctgtgctgcgtcttttccaagaccgtttaagataacacgaagaggtttctgacgaaccttgtttgccttctcagcgataccgattgcaccctcagcagctgcaaatgactcatgtccagctaagaaacagaagcactctgtctcctcctcaaggagcatcttaccaaggttaccatgtcctaaacctactttacgatgatctgcaacagatccaggaatacagaatgcctgaagtccttcaccgattgctgcggcagcatcagcagctctcttgcatcccttcttgattgcgattgcagcacctacagtgtaagcccagcaagcgttctcgaaacaaattggctgaatcttcttaacctgatcgtaaacgttcagtccagcgtcctttgtaatcttttcagcttcttcgatagagctgataccatagctgtttaaaacagcgttaatctggtcaattcttctttcatatccttcaaataatgatgccattatatcgttctcctttccaattattcctgacgtggatcgataatcttaactgcatcgtccacacggccatactgacccttagctttctcccaagctgtgttaggatcatcacccttcttaatgaagtcagtcatctttccaagagaaacgaactggtaaccgattacctcgttattctcgtcaagagcgatacctgtaacatatccttcagccatctcaaggtaacgaacacccttctcctttgttgcatacatagtaccaacctgagaacgaagtccctttcctaaatcttccagaccagcacctacagcaagtccgtcatcagagaatgcagactgtgtacgtccatatacgatctgtaagaaaagctctctcatagctgtgttgatagcatcacaaactaagtctgtatttaaagcttccagaattgtcttaccctgtaaaacttctgcagccatagcagctgaatgagtcataccagagcaaccgattgtctcaactaatgcttcctcaatgataccgttctttacgttaagagaaagcttgcaggcaccctgctgtggtgcacaccagccgacaccgtgtgtaaatcctgaaatgtcctcaattttcttggaatgaacccactttccctcttccgggataggagctggctcatgctttgcgccctttgctacaggacacatgttttcaacttcctttgtgtaaatcatcttaagactcctttcgcatgttaattgtagataaactcgttatcattcgacataccgctaatatttttgcatatttttttcctaaagtctagtgcaaattcgcacttttttagatacaactactatttttctttttttgccacaatatggtctgcatccttgtagatatggtttgccggaatcactccgcggacagaagaaagcggatagacattacaattcgggcagataaccgtacccggatttaaaacagagttgcatcctacctctacgtgatctccgagcatagctccaaatttcttaagtcctgtttcaatttcttctccggaatctctgttgtcctttacaaccacaagtgttttatccgattttacattggaggtaattgaaccggctcccatatgggacttgtaaccgagaatggaatccccgacgtaattgtaatgtggtacctgtaccgtgttaaaaatgatatcatttttgatctccgtggaatttccgacaaccgatccttttccaatgatcgcactcccgcggataaatgcacagtgacggatctcggcatcttcatcaataatcagcggtccgttcaggcatgcagtaggcgcaacggttgcactctttgccacccagatattttctccacgtttctcataaatttccggatcgagtgtcggaccgagctttttgataaaatcgctgattccttttaatgcttcccacggatatgtaaactgtgaaagatactctcccgcgatagactgtgataaatcatacatgtttttgatttttgcgttttccattttttaatctccttacattttaattttcatgattactgatcgtttttctttcggactcttccgtttcctccaaagccgttgtttcctctgcggctgctgcttccttcggcggtgcctcccccggattatcaaaatcaaacgaaatctgatcattttcatatttcaggcaggtgtcaaatgtattgcctgcctttgaggtaaatccggcaatcttctgcttcgtctttccggtcgtcagcagttctttcatcacttcttcggaaagttccaccttagcaacggtatgccagattttaaatccgcacgcacattcatacctccactgcgtcttcatcagcattttgccgcatttcgggcacggcacggttgtctcttccggtttcggtttctctggaaaatcaaatgcgatctccccttcttccgtcagtttcagcggcgcatcaaatttcataccggtctttgccacaaatcccgaaattacctctgtcttctttttcgtcagaagctctttcacctgcgcttctttcagccggacacttgcgatacttccaatcataaagctgcagctttccttatcatcttttttatgattggcacacataaatccaaacggtgccactacaatatccccaccacacttcgggcacttcacatctttgactttctttggctctacattgtcaaaatcaaatttcagcccggttactttcccgttttcatcttttgcgagagctacgcgcgcatcaaatttcttccctgtttttgacttaaacccacgcatggtttccgtaatgccatcgtttaaaagctgccggacctgtgcttccgtaaaagatttctctgccatcttcccaatagaaaacctgcagctgttctcatcacccggcttatagttggcacatccataaccaaaagaggtcgcaatgatctcacccccacagagcggacactttacatcgcggatcactttctgttccacgctgtcaaaatcaaatacaatattcgtctttccctcttcggttttctccagtttcagacaggcatcaaattttttaccggtttttgatttaaaaccgcgcagggtatctgtgtgaccatccatcaggagctgctttaccgcagtaaccggcagggtttttccggcgatcgttccaatggaaaaccggcagctgttctcatcgtccggtgaaaagtttacacatccatagccgaaagatgtctttttcatctgtccgccacataccgggcactttacctccggaataatttccggctctacgtctgaaaaatcaaatgcaatattaacttttccgtttttatctttatctaccttaagttttgcatcaaaccgtttgcctgccttggatttaaacccgcgaatggtctgggtatgcccctgttcgataagttcttttacctgttcctcactcagctgagcacctgcaatttcgccaatattaaaattacatcctgatttatcattcttataattcgcacatccatagccaaatggcgtggttacaagttctccaccgcatgccgggcatctgacgccaatctttcttctcgcaccggcacctcttgcatgtttcccggcaaaattactgatacgttccgcaagcggttcccgcagatcctgtccgatcatcttttccgtttcggtccggatgaaatcttccagtttcgtccggtaatcccagaaatccacggttccctgtgtaattccatcaagtcccttttcccaggaagctgtcatcttcgggttcaaaagtgccgggacggtcatgctcaccacttcaaataccatctccccgagattttccggtgtgagcacctgcgtccgtttattcagattgaggtaatggatacggaccagtttcttgataatttccgcacgggtggccgaggtaccgattcccgaacctttgatctgttcccgaagctcctcatcctcaatcagctgtcctgcattttccatggcaagcaccatggaaccggaggtgtaccgcttcggcggtgaagtttttccctctttcacctcatatccatccacggaaatctcatcgccctttttcagctgatctgccagatgtagcagttccttcggatccgaatcttcttcctctttctttggaattcctgcaatttccaaataaccgggtatctttaatacacgtgcagacgcataaaaacgttccttattttcccccacatccacaacagccgtcatttttacattctgatattctgccgccggataaaacacactgagaaatctccgcacgatcagatcaaataccgatttctgcagagcattcagtttcccaagctccgtgagctgaccggtcggaatgatcgcatagtggtctgtcactttagcatcatcggtatactgcgttcctgcaatatttccatacagctttctgtcgagaatctgctccacaaaatccgaagtcggctcatatccccgcagacggctgatatttttatgaatttcctttgccaccggagtagaaagcacacgcgcatcggtacgcggatacgttgtcagtttccgttcatacagatcctgcgccacctgtaaggtttcatccgggctgatcttgaatcgttttgcacattctgcctgcagctctgccagattaaacagtaacggcgcccgttttctggaaatattcttttccatggattccacaatcgcagaatgtccctgcacgcggtcaatcaatgccagtgcatccttcttttcccgaaatccgttttccttatacaaaagcggcgatgcaaagtaccctgatccctcgacggctttccactcgccctgaacatgtgcatctgtaaaatttccgacaacacggtaaaacggtgtctccttaaaattgcggatctcgcgctcacggatcacgaccatcccaagcacacaggtcatcacgcgcccgaccgcaatagcggtataagaacgtgttcccgccgcattgtttaacaatcctccatattttaccgacattacacgggaaaaattaatgcccatggcataatcttcaatggtacgcataataccggattttccaagattttcataggcagacatcggttttgcttcccggattccccgttggatctcttcctctgtctgggaatcaatccagacccggagttcctccatgccgtctcgcacaccgccgaaattgcggatattttcctcaatcgtctgtccttcttttccggcatctcctgcccagtagacacggtcgatatcctcgcgcatcaacattccgtgaaccacatcatactgccggctgacatctttgatcacatcatatttatattcttttggaagaaatggcagatcttccagtttccactttttgtattttatatcataactttccggatataccatggctaccagatgtcccacgcaccaggtgatcacatatttctggttttccagatagccatctctgcggcccccgcttaccccgagaacttttgcaaattcctgggcaaccgacggtttctccgttatgatcagtgactttcccatcttctatcccctattggcaaactttttctataattcgttcatatcaatcagctcaaaccggtcatccgttttggcatgctccgccagcatcggttcaaaccgcgttgcagagaataaaaaaatatgctccgaacggatttttgccttttccatgttctgatacagttcctcgcacatctgcgatgtcagctgtggctgatcccagttacatagtcccacaatatttctgcggtctgtgctctgggcaataatatcaatgtttcctgtctttccaacccaggttccgatcttatgaactggaaacggcatgcgtcccatctgattcaaaagcatcatatactccatgcagacattccggaaataacgtttcagatacgtgccaagttccggtgcaatgtaacggtcgtaaaattcatacggtttcagcagataaagatccgacatgtggggaaatacaaatttaaaccaaaaattaataaatgtatctttgatctggtatacccctttcttagtattttcccagccgccggtctgaaatgactgcactttctctacaatatcaaaatggctgagatttttcatataaacactgatctttgcacgggaatatccggttttcaaatacaggtcattcagtttattatatccctgtgcaattgcagataaaattgtgttatagacggaaagttcacgcagttctgccgaaattttctgttctgccatatgaaacagatatccgccctccgtcagcacaagccggtaaatattctccctgtatgaaatttccggattccaggcttccatatatcccggcaccccaccgatcgatccataaatacggatacagtcgctgaccgaaagtgccggaaatgtccggacaacttccaggaaattcagatcttccactttatgcagtacatcaatatgacggaatccatccccgaacgcatcttttgcatcctgcgtggcccatacaatggaagaagacgccagaatgatcattaccggtcccggataaagccttttcatcttcagttttaaaatacttttgacaaattccggatctcttttaattgcatactgtgcctcatcaatcacaatcaccagttttgatgcatctccgctttttacccggttaaaaaattcatcataggaatatctgctcagcttcatctgaaaagcattttgaatttcttctcccattttctgcatctgttcctgtgcggaaagctgtctgcatcgataataaaaatactttttccccatacaaaattctttgatcagctgttcttttcggcagtccattccgccatacaaaagcatcagctggtttcctgatttttcataccagccttccagttctttgagatctgttttttttgcgttcatcccgattcctccgtacaaaattccttctgctaaaagaaattatatcactgattaatatctctcacaaggttttcggcaaaaagaaagaagtgcagtttttgcacttctctccaaaaatccgtatttcaatttgatacttatttctttgtgatatatccctgtgcctttaacagctctgcacataaaactgcaccaccggctgcaccacgaacggtattgtgagataatccaacgaatttccaatcatatacggtatcctctctcagacgtccgacagagattcccatgccatgctcaaagtttacatccaggctgacctgcggacggttgtcctcttctaagtactggatgaaatgttccggtgcacttgggagcttcagctcctgtggcacaccactgtaattcttcagtgcttcgatcagctgctctttggtaggtttcttcttgaatttaacaaatacagctgctgtatgtccgtttaataccggtacacggatacactggcaggtaatgactggtgaagttgcaggaacaatctgcttcttctcatcatctacatgtccccagatacgcagaggctctttctcagacttttcttcctcaccaccgatgtatggaataatgtttccaagcatctccggccagtccttgaacgtctttcctgctccggaaatagcctgataggtagtggcaacgacttcatatggctcaaactctttccatgcagtcagaaccggcgcataactctggatggagcagtttggctttactgctacgaaaccgcgctttgtaccaagacgctctttctgatacttgataacttccatgtgctgtggattgatttccggaactaccatcggcacatccggtgtccagcggtgagcactgttgttggaaacaaccggtgtctctgtctttgcgtaatcttcctcgatctttttgatctcgtcctttgtcatgtctacagcagaaaatacaaagtcgacctgagaagctacctgctctacctcatttacattcattactacaatattctttacagcttccggcattggagtatccattttccaacgatctcctactgcctgctcataagtctttcctgcacttcttgggcttgctgcaatcgtggtaacctcaaaccatggatgattctccagcaaagagataaatctctgtcctaccatacctgttccgccaaggataccaacttttaacttctcactcatttttccaatctcctctgttcttttctttatacgcggacacctgtcttttacagaaaaacatttttgttttttgtccgtgttacacgaacatgtgtctttataggaaatatattacttgaaaccaggtaaaattacaaggaacaaattgtcctaaataaataaaatattcctcaaatatatgtaggacttgcacaatctgaaataccgactaagcggtatttcatgcaatatatcagagatgtaccgcaattacgtacatcgcatcgcacaagcgattctgcatacgatgtgctccttttgtctcattttttctccagatatgcctcttcgattgcgatcactttcttcatcgcctcttcccctggtgcaccgatcgtcagacgcttgttgacacaggtttccatggagattgcatcatagacatcctcctcaaatactggagaaaactgttttaattcttccagactcatatcgtcaatcggcatctgtttgtccagacagtacaaaacaatacgtccgataattccatgcgcatcgcggaacggaaccccgtgatttacaagataatcggcagcatccgtcgcgttggtaaagccgtgtgcggcactctttctcataacatccttattgaatttcatggtatcaagcatgcccgtgaataacgcaatacagcctttcgttgtgtcgatggcatcaaaggaaagttccttgtcttcctgcatgtctttattgtaagcaagcggaatccccttcattgtggtcagaagtgacataagcgcgccatacacacgtccggtcttgcctcggacaagttctgcaatatccgggtttttcttctgtggcatgatactgcttccggtactgtatgcatcatcaatctctacgaatttgtattcgttagaattccagatgataatttcctcggagaagcggcttaaatgcatcataatggttgccatggcagacagatattcgatcaggtaatcgcggtcggaaacaccgtccatactgtttaaggtcggtccgtaaaagccgagaagctctgcagtatattcgcggtcaagcggataagttgttcctgccagtgcgccggaaccaagcggacagtaattcatgcgctcgtaaatatcgtgcatacgggaacggtcacgcttaaacatttcaaagtacgcccccatatgatgtgcgagtgtgatcggctgcgctttctgcaaatgggtaaatcctggcataatcgtctgcgtattttctttcataatgcgaagcaatacctgcagcagctgttccagcagttcatccgtctcaagaacctgctgccgggtatacagacgcatgtccagtgccacctgatcatttctgcttcgtccggtatgcagtttctttccggtatctcccagacggtcaataaggtttgcttccacaaaactgtgaatatcctcatattccgaagtgatggcaagctttccgctctccacatccgcaagaatttcctgtaaacaggaaacaatcgcctgcatctcttcctgtgtcagaatgccctgctttccaagcatacgcacatgtgcaatggaaccctcaatatcctgcttgtaaaatttctgatcaaacgaaatggatgcattaaaattgtaaaccagctggtctgtctccttcgtaaatcttccgccccataactgtgccatatctaaattcctctctttcttaaattctttgttgtatttttataacatctgttcttcctgctgtctgcgcagtacgatttcacggtcgcggtcacgcttggaatacacacacccacagtagtactgccggtacatgtgatactccttagaaatttcggtcgactttttatagccttccttcttttttaaatccgaaaacagataacggacaccaaaggtatctgccagttctgctccgatctgatttaacttttccgcatttttcagcggactgatggatagtgttgtcgtaaagaaatcaaatccgtgctcttttgcataggacgcagcctcagaaagccgcagccggtaacaggcaaaacagcgctctcccccttccgggatctcttccatgccctttgccatatcgtaaaaccgctgtgtatcgtatgcaccttccacaaaagaaaccggatattttgtaggaaactcagcaataaaacgttcctgctcctttgcccgcatatgatattcttccggcggataaatattgggattgtaataaaataccgttacatggaaatgttctgcaagacatgcaatacaataagaactgcacggtgcacaacagctgtgcaaaaggaggcttggagcctcccctgccgtacagttttcacggatcagatcttccattattttctgataattttttttattcatctttcatctgtatacatctgattaaaaatttcttttccggtctgcgtccggaaaatctgctgatatgcctgttcaattccgtgacgattgacgtcatcttcatataaattgaccagaaaatctgcctccaccagaatctgataatccagtccttcgatattatcatatgtatgatgatgtccgatcagatagcagatacggtcgatcagataattttcaattcccacatcggaaagcattctctgtgccacaatcggtccttcctgctcctgcagctttccgtcacaccgtccatacttttcttctgccggacggattccaatgtcatgggtataagcggctgcttccaatataaaaagggatgtctcgtcaagcccttcttttgttccgatgattcttgcgaaactatgcactttcatgaaatgctgaatccgtttcggatctccggaaaaaaaggcgatcatctgtaaaaacagctcatccagctgttgcctgctgtaataactactgtcactactgtccattctgtgtttctcctttatctaacatctgcagtgcaaacgtcgctgcaatgtaaacaactgcacataaaataatcaatactgttttttccccggcaacaccggcacaaagttctgccagaataagaagtccatgcacccagagttccgcatgatgcagcatcactgcaataactgcctcaatgataacaagcagacacataggaactaccggaacgttaaggactctcacccctacaatcaccataattgcaacaattgctgcaaaggccagtaatgtcggtacctgaaacgtctttttgttcttgtccattttttacctcaacctttattcttattttctttgtctgcgcccattataccaatttcatgcctaagaaacaagcactttttaaagtaaaaaagacacgtcttccatcggatacccgatacaaaacgtgtctgaaacgaagccaataaggggactcgaacccctgacccacgcattacgaatgcgttgctctaccaactgagccatattggcaaaacgtacttgtatataataccaaaaccgattcagaaaatcaactgttttttcataaaatttatattaaaaaaagattgacttttcacatggattctgtagaatagaaactgttgagtttataatcagtaaacaaaaaatcaactaacaatcatgtttcataaatttacgggaggcatgccatggacattggacaccgcatgaaagaactgcgcatccagtacggactgacgcaacaggagctggcggaccgtgccgagctgaccaagggctttatctcacagttggaacgaaaccagaactctccgtccatcggaactcttctggatatcatccagtgccttggtacgacaccagcagaattttttacagatgaagagccggaacagattgttttcaaacaggaagattattttgaaaaaaccgacgaagaaaaacactgctgtattgaatgggtcgttcccaatgcacagaaaaaccagatggaaccggttcgtctgactttacacgccggtggacggtcagaagtttatcagccccatgagggggaggatttcggttatgtaatcacaggaaacgtccgtatccactatgccggacaaaaccagacggtacatgccggggaatctttctattttaaagcaggaaaaaagcattatctggaaaacaccggttcgaaagatgccgtcatcatctgggtgactaccccaccaaatttttaagaggacaaacgtatgagtaaacatttaattgattttattggaatttccaaatcctacgattccaatcttgtgttggatgatttaaatctgtatatccgggagaatgaatttctgacccttttaggtccgtccggatgcggaaaaactacaaccctgcgtctgctgggaggctttgaaagcccggacaagggacagattctgtttgacggacaggatatcacagctcttgcagccaatgaacggaaactgaataccgtttttcagaagtattctcttttcccgcatatgtccatcgccgaaaacattgcattcggccttaaaataagtaagaaaagcaaagcatatattcaggataaaatcaaatatgccttaaaactggtcaatctggaaggctttgaaaaccgttcggtcgattctctctccggtggtcagcagcagcgtatcgccatcgcccgtgcgattgtaaacgagccaaaagtccttcttttagatgaaccgcttggtgcacttgatttaaaactgcgccagagcatgcagtatgagctcatccgtctgaaagaagaacttggaattacttttgtatatgtcacccacgatcaggaagaagcactgaccatgtccgataccattgttgtcatgaatcagggatatatccagcagatcggtactccggaaaacatttacaacgaaccggaaaacgcatttgttgccgattttatcggacacagcaatatcattgacggaaccatgataaaagatgaacttgtagagattctcggtgcccgttgggcatgtgtcgacaagggattcggcaataacaagccggtcgacgttgtcatccgtccggaagatgtagaactggtcgatccttcggagggaacgctgcagggcgaagtaacctccctgatttttaaaggcgttcactatgaacttgatgtcatggccggcggctatgaatggctggttcacaccaccagatttgttccggtcggcaccaaagtcggcatcaaagtaatcccgttcaatatccagattatgcataagccggaatcttccgatgaaaaggcggtggagatcgatgcgtaaattcaaacagcaatttcttgccggtccatacctcatatggatcattggttttatcctcctgccgcttatcatgattctttactatgcatttacaaacggcgatggcagttttacgttatcctatatcacagcgatagcagatgaaaccaaccgcaaagccatgggactttccctgagacttggaattatatgcaccatcgtgtgcctggttctttcctatccgctggcaatgattttaaataatatgaaaatcaaaaatcagggactggttgtttttatctttatgcttccgatgtggatgaactttatgctccgtatcctggcatggaaacttctgctttccaaaaatggtgtaatcaactccattctcacaggtttcgggctttcccgcatcaatatcataaatacaccaacagcagttgtccttggcatggtatacgacttcctgccatttatgctgctgccaatctacaactccatgacacgaatccgtaaagactggattgaggcggcccgtgatctgggtgccggaaatgtaaccatctttttaaagattatccttccgcttaccgtatccggaatcatcagcggaatcgtcatggtatttgtcccgtcacttacctcgtttgcaatctcgcaggtattaggcggtggtcatgttcttttaatcggaaatgtgatcgaacaggattttatgcagggtatgcaatggaatgccggaagcggtctttcctttgttcttatgatttttgtgattgcaagtatgactattgtaaatatatttgataaagaaggggagggaacatccatatgttaaaaaaatgtgcatcccggatctatatggtcctgatttttgccttcctttaccttccgattattgtgttgattgctttgtctttcaacgattcccgttccaaggtaaaatggggtggcttcacgctccggtggtataccggctgttttcaggacgaaaagattatgactgcatttgtcacaactttgcaggtcactttcctgtccgcaattatttccacactgatcggaacacttgccgcgctcggcatagccgccatgaaaaaacggcaccagaccatttatctcggcgcgaccaatattccgcttctgaatgcggatatcgtaaccggtatctccatgatgcttttgtttgtgaaatttatcgacctcggatttgtgacggttcttctggcgcacattacttttagtattccttatgttattttaaatgtgcttccgaaaatgaaacagacaaaccgcagcacctatgaggcggcacttgatctcggagcaacgccgctgtatgcattttacaaagtcacctggccggaaatccgtcccggtgtgttctccggatttatgatggcagtcaccatgtcactggatgatttttccatcacctattttaccaaaggagccggggtcaataccctctccaccatgctctacacagaacttcgcaaaggaatcaaaccggaattgtatgcactttccacgattctgttctttgccgttctgctcattcttcttgccggaaatgtttatccggggaagaagcgtgttgcagccaaataaattttccattggaattttattccagccgaaaggagtcctattatgaaaaaaagaattttctctgccctcttaatttctgctctggcagtcagtgcactcactgcctgtgggggatcttcctctgcgaaaaaaagcggacagaccttaaccgttttaaattacggaaaatatatcgatgagtccgtagtcaaacagtttgaaaaagaaaccggtatcaccgtcaaatacgaagaatatgaaagtccggaagaaatgtataccaaatacaaagccggttccatcaactatgatgtaatctgctcttccgaatatatggttgagcgtctgatcaacgagggcgaagttctcgaagaagattacgatgccatggacaactacaaaaatctggatccaacgatccttgatatgtctgcttcctatgacaagaatcacacctattccgttccatatttttacgggactcttggccttctctacaacaaaacaaccattgatgccaaaaccgtatcaagctggaactgcctgtgggatcctacctatgaggatgaaatcatcatggaaaattccgtccgtgatacgtttgcccctgcactgatctccaaagggtattccttaaacgataccgatgaaaatcatctgcgggaagccctcgacatattaaaaaagcaaaaagatgataaaatcgtatatgcctactatgtagacgagacagccgatgccatgatcggagaagaagcctccatcgcactgtgctactccggcgaggctgcactggccatggcagagaacgacaatctggattattcagttccaacagagggatcaaacctctggatcgattcctggttcattccaaagtcctgcactaaccagaccaacgctttaaaattcttaaatttcctgtgcaaggatgatatcgcagaaaagaatttcgaatatgtgcagtatgcctctccgattacatctgtggtagaaaatcaggacgctgacgtaaaaaataacgaagctatcaatccttccagtgacacgataaaaagatgtgaaatctataaagcattaagtgatgatgattccgccaagtacacaaagctgtggcaggaacttctctcttattaaaaaaccgagaaaaatgattgcaatttcagtcaaaacatgctaaagtaaatccacggtgtctggttaacaccgtggatttttcatcttcggaaacggtcattccgaaatttcccatatatacatttgttttcaattacatatgaactatcaggaatttttaacaacgatccgtacacagctttctctgcgtatcgagacaggtgtcactttagacattcgttcctttaccaaaaataacggaacacattacgatggtctggtacttctccatccgaagaaaaacgtgtcacctgcgatctatctgatgccatactatcatcgctatctggaaggggtatgccttgaagaaatctgtgaagatattcttcatacctatcaggcgcatgccccggaagaaaattttgacacgtcctactttaccgatttttcccgtgccagcgagcacatcgtcatgcgtcttgtaagctttgaaaaaaatcaggaactgttaaaagaggttccgtttttccgctaccaggatctggccgtaatcttttactgtctgctccatgcaagtgccgaaaaccaggcaaatattctgatccacaatcatcacttaaacctttggaaaaccgacaaagaaacgctttaccggcttgcgaagaaaaacacgccacagcttcttcccccacagcttaccccgatgagcagtcttctcaaagaaatgcagctcgtcgcggaaactccactcccggaagcagccccgccactgtatgttctgaccaatacgtaccggaccaacggtgcaaccgttctcctctacgatgacatcttaaaagaactgtccgatttgtttgaaaaggatctgatcattctgccaagcagtattcacgaagtactgattcttgccaccgatgaaaacgacaggcagaatctcgaccattacaccgcaatggtaaaagaagtgaatgcctcacagcttcaggatgaagaaattctgtccgaccatgcctactattactgccggcacagccatctgctgaccatgccgcagccggtctgcacttcatagattatatttccagacacaaaatccccgcagaaaaaattctgcggggaacatctattacatttctaccagtttatcatatagcttctcatatgcatgtgccgaaacattccaggaaaaattgcgatccatcgcacgatagatcagttctttccatgcggccttttgttcatgctccacacgatacgcataccggacaatatctgccatttcctgtgcattaaaattcgcaaatgaaaaaccacatcctgtattttcatattcattgtatggttctaccgtatcccggagtcctccggtttcacgtacgatcggaagtgttccgtaacgcatggcaatcatctgtgccagcccgcatggttcaaacatggaaggcatcagcagcacatcacttgccgcatatatatggtgcgaacgctcctcggtaaatccgatatgtacgcttaccttgtccggatacttactctgataatggtggaacatattttcatactggctctctccggaaccaagaaccaccagctgtatatccatttcggttaaaagttcatccaatacgcagccaatcaggtcaaatcctttctggctggtcatacgcgatacgattccgatcaggaaagcatcctccctgactggaagcccaagttctttctgtaatgcaactttgttttcttttttcccactcactgcatcttttttcgaataatttaccgaaatataaggatctgtctgtggattatattcttcataatcaattccgtttaaaataccataaaggcgatcctttcgggcagtcatcaggccacttaagccctctcccccttctacggtcgtaatctcatttgcatacgtcgggctgacggtagtaatataatccgcatataccacgccaccctttaagtagtttgcttcgccataagattccagttcatatgcattgaaaatgtgtgccgggagtcctgtaatatccataatctcctgaattcgccagcgtccctgaaactgcaggttatgaatcgtaaacacggttttgattcccgcataaaaattatcatctccaaataccgtatgcagaaacaccggaataagtcctgtctgccagtcattgcaatggataatatccggggcaaaatcaatatacggcagactagcaagtactgccttggaaaaatatgcaaacttttccacatcttcatagatattgttgtatggagattctcctgcaaaataaaattcattgtccacaaaataaaagtgaacaccatgatattccgactcgaaaattccaacatactgcctgcgccagttcagatttacataaaaatggcacaaaaattttaaatttggaagaaatgagcgatccatgcaggcgtatttcggaataactacccgcacatcatactcttttttgtcaaaatatttcggaagtgatccgacaacatcggcaagacctccggttttcacatatggcactgcctctgatgaaacaaacagaatcttcttcatacataacactcctttacttactcttcatctgtaatcgtattttgtccgtaataagagcgataaattccgagttggtcggttttccttttccattgctgatcgtatatccgaacagatcatccagcgtatccatcttgccacggctccatgctacttcaattgcatgacggatggcacgctcgacacggcttggtgtcgtatcaaatttctttgcaatccccggatataaaattttcgtaatagaatttaacatgtccatattcgtcacagacatgatgattgcctcccgcaaatactggtatcccttgatatgtgccggaacaccaacctcatgaattatctctgtgacatcctcttccagtgtctgtaacgagtacttttccggtttcttttccatctcaaccggtctgccaatttcttttcgtactttgtttttttgacggttgagtgtcttgatccgatccaaaacaatattccggtcaaacggcttcataatgtaataatccgctccccgctcaaacgcgtcttcggtaatcttttcattgctgatcccactgatcatcagaaatgttggccgattctttagtgtatgatctgccctgatcctgtcaaggactgccagaccgtccagtttcggcataataatatccaataatacaacatccggttctttttccctgatcagatgacaggcttcttctccatcctttgccatcccgatcaggtgcagttcatcatcactggttaccatttcttccaataagtcacgcataacctcgttatcatctgcaattgcgacatttagttttcccatgtaggcctcctagaatgtcaaattcagtcaaaaataagcataccagaaagcactgtccgattttgtcaaaatttgtcgataaatacagttaaactatatcacaactgccaatttatttcaatgtcttatgcattctcttcgaactgggaattatacagatctgcataaaatcccttttgtgccagaagctgttcgtgtgtcccctgctctatgatatcgccatctttcatcaccagaatcagatccgcatttcttatcgtagagagtcgatgcgcaatgataaagctggtccgtccacgcatcagattatccaatgccttctgaatccgcacttcggtacgggtatctaccgaagaggttgcctcatccagaatcagaatcgggttatccgcaaggatagcacgtgcaattgtaagaagctgtttctgtccctgggaaacattacttgcatcctcgtttaactccatctggtagccacccggaagtgtctggataaaatggtgggcatgtgcggcttttgccgcctcaatcacttcctcatccgtggcatctaaacggccataccggatgttttccatgatagatcccttaaacagccaggtatcctgcaataccataccaaatgcatcccgaagctcctgacggttaaagtcgcggatatcatgcccatccacctgaatggctccgcctgtcacatcatagaaacgcataagcagtttgaccattgtggtttttcctgctcccgttggtccgacaattgcaattttctgtccaggtgttacatgagcggaaaaatccctgataatgatctgatccggattgtatccgaaacttacatgggaaaaatccacgtaaccatccacatggtcgagatgcacagcatgttcaaccgtcagttcttcttcctcttcgtccagaaattcaaatacgcgctcggaggctgcagccatcgactgcagcatatttgccacctgcgcaatctgctggatcggctgagtaaaattccggacatactgaataaatgcctgaatttcaccaaccccgatggttccgcggattgccagaagtcctccggaaattgccactccgacataaccgaggtttccgacaaactgcatgatcggctgcatcagtccggataaaaactgggacttccatgccgattgaaacagaatctgattggtatcttcaaattttttgatggtgctctcctgcttattatatgcctgcaccaccagatgtccgccatagacctcttccacctgtccgttgatatgtcccagatattcctgctgctggcggaaatatttctgcgaatgtttgataataaacgaaatcaggatggcagataccggaagaatcacaagtgaaatcaatgtcataattccggaaattgaaatcatcatcacaagtgttccgaccagtgtcgccacactcgtaatgatctgcgtcacactctgatttaaactctgtccaagtgtatccacatcatttgtgatgcgggatagcacctctccgtacgtgcggctctcgaaatatttcattggcatgcggttgattttctctgaaatttccttacgcatgcggtaacaggttttctgcgtgattcctgtcatgatcattccctgtataaaactgaatactgcagaacagatatacaggccaagtgtaaacaataacactttggcaatataggtaaaatcaatagatccggttcccgcgatcttttttccgagaccttccaccaatgcattcgttgcacgtgccataacctttggtccggcaacggaaaagacggtagacaccgctgcaaaaatcataacggcaacaatcgcataccagtatcttccgagataacgaaccagttttccgatggagtttttgaaatctttcggcttttctcccggcatcattcctctgcccggacctcccatcggaccgcgaggtctttttgtacgttgttctgccatcttatttcacctcctcagaaagtcccagttctttggcagacagctgacttctggcaatctgctcgtaaacttcgcaattgtgcagtaattcctcatgcgtgccttttccgacaatctttccatcgtcgagtaccagtatctggtccgcatgcagaattgtactgattcgctgtgcgacaatgatcacggtcgtatgttccgtctttgtctcaagtgctctgcggagtgccgcatcggtcttcatatccagagcggaaaaactgtcatcaaacacataaatctttggattttttgcaattgctctggcaatggcaagccgctgcttctgtccgccggaaacattgcttccgccctgtgcaatcgcactctcatacccatcctgtttgctgtcaataaactctgttgcctgcgcaatctccgctgcttcccggatctgctcatctgacgcatcctctgccccgaagcgcagattgcttgcaattgtaccagagaaaagaactcccttctgtggtacaaatccgatatgttcccgcagatcctgcaatgtatacttgcggatatccgttccgtcaagcgtgatctctccacctgtcacatcataaaaacgcggaagcaggttgaccagcgtagatttaccacatccggtacttccgataattgcagtggtctttcccggctctgcaacaaaatcaatatccgaaagcacatcttccgtggctcccggataccggaaatttacatgatgaaaggcaatcacaccctcacactgttccatggcaaccggctctttcggatctgtaatcgtactttttgtgcctacaacctcatctatacgctctgcagccacaccggctctcggcatcatgatagacatcatggtcagcatcagaaatgccataacgatcatcattgtataagtaataaatgccgtcatggaacctacctgcatatatccgccatcgatccgttttgcggcaacccacacgatcagaagcgtgatgcagtacatgatcatcatcattcccggcatcataaatgtcataacacggttggtaaacaactgcgtctttgtcagattgcggttggcctcatcaaaccgctcttcttcccgtttttcccgtccaaatgcacgaatgacatttaatcctgtcagaatctctctcgaaaccagattcagccggtccacgagattctgcataatcttaaactttggcatggcaagggaggtaagaagcattacaaacccaagaataacaagcaccgcaagcgcgatcgcccattccattcctgcatgggtctgtgcaaccttaatcacaccaccgattccaatgatcggagcataaagaatcattcgcagaaatactgcagtcaccatctgaatctgctgtacatcattggtacttctcgtaatcagggatgccgttgaaaaatgatccatctctgcattggagtactgtacgacattgcggaatgtcttatcacgcagatctcgtccgatggatgctcccacacgggaagcacaatatccgacaaccactgccgccataaccatcagcagcgcaaaaccaagcatcttggctccggtggtccataagtaatgtttctgaatggcatctacatccacacctgcatttttatcacaggagatcgcataggtcacacccatggatttcaatgtagaagatccgatcgcatcaatctgtccggacacctgctttcgcatctcaagaatctgctgatccggtacctggccggctgccagtgcctgcatcagctgcttcatatctacctgcgtcccatccgttcccattttccccgtgagagccttctcgtcaatatcggactccttcatctgggacatctgatataccatgacgatcggctccaacagagactcatccatatcgtcaagcgtatcctcttcacaatttctcacatagtttccatcttttttcggctccttataacaggcggcaaatgttttcttttccctgctggtcataaaaagctgtgctgacacaaaatcttcctgtgtcatttcttccggaagaatatgctccactccgctgctcatgattccgacatcgataatatctgatgtatactgtggcagggacagatcacaaaatgcctgcatcacaagaaaagccacaataaccagaatccatttccagtatgggagcatgtttttaaatatttttcccatgatttaactccttttcatatgcatagcttttatactatcacgaactgatttccagaacaattcctattatataaaacttttcttaaattaaaatgaaatgtgtggtgcaaccacgggcaccacacattttatgttctgattttataccgctggaattatataaccggccttcttcatttcttttgtaaaatcatcgacagacattcctgctttttctgcaccaatttccactgtaatgattccatcctttatcagggatgcatatgcctgaatctgaccttcacgtttgccttcaattcgcccttcacgctggccttcaagacgaccttcgcgttggccttcaattcgaccttccacgcgttcctcattcaattcatctgccatcaaaacacgtaatgcctcacacataatcctttcacttcctttccatttttgcactttctccatgttactgtttacaatgacctgcagcacgatatctgcaagattctagttttataaggatttagcctcccacaattctaaaaaatcaaagaattttaaagcgtggtggaatttacccctgcactggaatttactttttcaagtcagccgcgaatcgtatctaactatttccatgttactaaaacaaaggagaaattgtactattgagcaaaaagaaaaagcaaaccaagggggaagtgcgccctaaaaagcatttgtctcaggatgaaaggatcaccatccagaccatgcttgataacagcgcaaagccttatgagatcgcacagacgttgaataaatctccttccaccatcattcgagagattcgaaaccacacgaaaatcaacgactgcaggaagtggtccacttgcggaaaacgaaggatctgtattcgtacatactgtaattcggtctgcaagaaatgtgacaaacgaaactgttgggagatctgtcgtgattatgaaaaggatgaatgtcccatacaagatgcgtcgcctcatgtatgtaatggatgtgatcggaagttcaactgtggaatggagaagcgcttatacaaaggtgtagacgctcataccgagtataaggcagaattgcagacgaaaaggattggattcgatctgacggaggacatgttggataagattgatcaaaaggtatccccactcttaaaagcgggacattcgccatactctgtaattcagaccttgggagatgaacttccttgcagcgaggcgacattatatcgtctgattgatgcatgcgctttgtctgcaagaaatgttgacttacaggaacgtgtaaaaaggaagcccagaaaaaggcgcattttaagtaaggacgcatatgcaatcatcactgctgagaaaaaaggccatttatggacggattatctgaaatatatcagaaaccatggatgccatgtcttgcagcttgactgtgtagaaggaaagaaggaggataaggcggtccttctcacgctccattgggtatctgagcatatgcaactttattttattatggataatcagacttctgaatgtgttgtggagatgcttgacagaattgaaacggctgtaggtacggaggtatttcgagaagctatcccaattctgctgaccgataatggtcatgagttcatggatgtaaaaggtatggagaggtcatgcatttatcctgatcagaaaagaacaaacgtgttcttttgtgaaccgaatcgcccggatgaaaagggacactgtgagagaaatcaccggttattaagaaaagtgattcctaaagggacctcattggaaccatacgatcagagagacattacggtaattacaaatcatgtgaacagttatgtccggaaaagtcttggtgggatgtgtccttatgatctggcgatggagcgtttgccggaggatttctttgatctgttgggcttagagcttatcacaagagaaaatgtaaatttaacaccgatgcatcacggacatctttctgctggatgataagaataccctatctgagctaatgcttggatagggtatttccttgaaatttctcagactaaatgcaaaatattttattttcagactaaatgcaaacactttttgcatttaatttgaaaaataaccagatacaaaaaattttaatttagtactaaagtattccccctttcgtccgatatatatgataagtaaacaaggaaaccccattgtttaccccataagacagacctctgaccggagcgtacggccgcaaagaggaaaagcttataattaaatattcatatcaattacagcatggaagctgtaacttaattcaaggaggaaattattatggcaatggtagtacaacacaacatgaccgcagctaatgcaaacagaatgcttggaacaacatctagtgctcaggcaaaatcagcagaaaaattatcttcaggttataagattaaccgtgcaggagacgatgctgctggactaaagatttctgagaagatgagaagccagatccgtggtctcaacaaggcttctgataatgcacaggatggtatttctcttatccagacagcagaaggtgctttaaatgagtctcactctatcttacagcgtatgaacgagttagctgttcagggtgctaacgatacaaaccagtcaattgaccgtgatgctatcaatcaggagttagaggcgttaacagatgagttagacagaatctcacagacaacccagttcaacaaacagaatctgttagacggtaacttcaaggataaaaagcttcaggttggagcaaatgcaaatcagaatattgaaatcagcattgatgctatgaatgcggattcacttggtcttggcaaggagatggttacacagggcggaacaactccaatagctgttaaatatgatggaataagctataaatatgatgctaatacaacagcagcgaagaataaagaactggctattggatcattcaaagcgcaaatcagtaaaaaagtcgtatctgctgcttttacagctcagtacgataatacaacaggttctatttactacaaagcaacaatcgacggaaaagagaaacgttttgcagatgctactaaagctaaaaaagcatatttagatgatcagaaggctaaagcatcagcagctattacaaatgatttccagaaatatgttcagactagcacaacggcaggaacaacaggaacacaaggagaagttcgttatggcgctcgtgttgatgattatgagtctgctaacaaaacaattacaaaagttcaggatgccatcaatacagtatctacacagcgttctgcacttggtgcattacaaaaccgtttagagcatacagttgctaaccttgataatgtatctgagaatactcagtccgcagaatctcgtatccgtgatacagatatggcatctgagatggttgactacagcaagaataatattcttgcacaggctggacagtctatgcttgcacaggctaatcagtctactcagggagtattatctctgcttcagtaattaatacgaaatataataaacgtatgacaaatgaaaaggaggtggcagtaatgtcagctccttttcttaataaaatataaggatgcatatgaagttaacagaattatataaagaagtttttaacagctgtgtagaatttgctgtatatggaaaaacaacgattgtcagtgatatgagaaaattactgcctgagctaaaggcatttacagaagaatttgttcgcgagaataaatttcaaataaataatgaagagtatgaacagttagtcagagtccttttggatattatgaaggatattgttcaaggaatagataatgaagatcatgtattattagaagacacctgtgaatttggggtaaagccatttctggaaatgtttttttcagaagaagagttaatgtgtttgagaaaagaggcatcggatggacaataatatatatacgaataatgtaaatgcattacagaatcgctttccaggattagcagaagttgtttcaaaaaaaatatataatagagatcaggacttaaaagttcaagtagaaacggcgtttgacggtaatcaaatacttatagttaataaggataatcggacattatatatagagggaaagagagaaccacagaagaaggcacagcgtgtgattgagcggtggaaaaaattaaataacgcaacgacgattgttgttataggaatggggaatgttacttttataaaggagttattgagacggactccaaagcaaataaatattatggtgtatgagccatcagtagaaatatttttgacattattagaaaaagtagatattacagaatattttaataatagagcattaggattaattataaatggaattaatgaaaacgaagcagaaccggttataaaagcatttattaatatttcaaatttagagtttataaaaaattatagaagtcataattatcaggaattttttggaacacaaattttagattttttaaagagattggatcgtataataacagaaattatagttaatgttaatacgggaattgctttttcgaaagttgaatcaaataatatatttcataatatagagcatgtatgcaatggatatgtcacaacacaattatgtgatgttattccgatagatattcctgcaatcatcgtatcagcaggtccatctttaaacaagaatataaatgagttaaagaaagcaaagaatcgggcgtttattgttgcagtagatactgctttgaagccattagtaaaggcaggaattattccagacttatatgttattgtggatgggaaaaaaccggaaatcttatttgactttgaagaagcaaaaacaattccattaatgacaagtatatcagcaccatataaaattttaaaagaccataaagggaaaaagatttttttcaatgagggcaatactattgttaatcatttatttgcaatgaatggaaaattattatatagcgtagcctgtggtggatctgtggcatgcagtgcattttcgcttgtgtataaaatggggttttcaaaaataattttagtaggacaggatttggcactaacgggcaataaaacacatgcagatggcacttttcaggagaaaatggatattgtagatacgtcgcattccgttatggtagaaggaaactatgaaaaattagtgcccacaagagctgattataaagtatatttagattggtttaattattatattgcagggtgtagagatgttcatgtaatcaatgcaacagagggaggggcaaagattcagaatacggaagttatgacgttgcaggctgctattgaacgagaatgttcaaagacggtagatatggatgcatgtttttccaaattgaaacctgcactaaatgaaacagaacgtttaaaggcagtagaatacttaaacacgattccatctatgttttctcatctgaggaagtatgtggataaaggaattagttattatgaacagttacaaaagatatgcagcaacaaaaaaattgatcaaagagcgtatttgtccaatttaaataaaataaaaaaaataactaaaaaaattgaagaacatgaattgtttggtatgatttctgacacgttggcaattgcggattatatggtcatgagtgaacaatattatgaagaagacagtttgcaggcagagggattggaaattgcgaataaaggaattcaatatatgaagcttgtggataaatgtattgatttatttataccgttagcagaggaaacggttggggaaattaaatagttgatatataatacatttggatagatttattgcaggagggaaaaatgttaaacggaaaaacaattctggtaactggtggaaccggatcttttggtaatgcgttcacacagtatgtgttggagcattatgaaccgaaaaaaatcattatttattccagagatgaatttaaacaatttaatatggcgaataaatttaaaaaatataaggacaaattgcgtttctttattggagatgttcgtgacaaagatcgattataccgtgcctttgatggagtagattatgtggtgcatgcagccgctttaaagcaggtgccagcatgtgaatataatccaatggaggcggtaaaaacaaatatcaatggtgcaatgaatattattgaggcggcattggactgtggagtaaaacgtgtcgtagcgttatcgacagataaggcggtaaacccaatcaatctttatggtggaaccaagctggtgtcagacaaactgtttattgcagcaaatgcatattctgggcagaaggatgtatgcttttccattgtaagatatggaaatgtagcaggaagtcgtggctcggttattccattttttcgagacattgtagcaaatggaggaaaagaacttccaattactgattatcgcatgacaagattctggatcagtctggatgagggtgttcagcttgtaatcaaagctttatcagaagcaaaaggcggagagacatttatatctaagattccatcattcaagattacggatctggcgcaggcgattcttccaggctgtaagatgccggaggttggaatccgcgaaggtgaaaagcttcatgaggttatggtgacgaaagaggattcgatgcttacatatgaatatgaaaagcattttatcgtatatccgcattttgactggtggaatacttcgaaaattcaggcaggtggaaaaaaggtagaacctggatttgagtacagctcaggaaataatacagaatggttatctgtagatgatcttgccagattgcttaaggatgtggaggagcattaaccggaaatgaatattgcgattataacagccagaggtgggagcaaaaggattccacataagaatagaaaagagttctgcggaaaacccatcatagaatattcgattcaggcagctctgggagcaggtgttttcgatactgtcatggtttccacagatgatgaaaagattgcgcagattgcgcgggctgctggagcggaagttccatttatgagaagtaaaaaaacgtcaaatgattacgcggcaactgctgatgttttgttagaggttctggaacaatatgataaaatggggcaacactttatccatgcatgctgtatttatccgacagcgccatttgtgacatccgaaaagctaaagcaggcaatggagatattacagaaagaggaacgatatagtgttatgccagttacggcattttcatttccaccattaagaggaatggtacagcacgaggggaaaattacgtataaatggcccgaatatgcaatgaaacgttctcaggatcttgaggaaatttatcatgattgtggccagttttatgcatttcaggtagatcaattccaaaaagagagaagactcgtggcagataacacagcagggattatcgtttcggatcttgaggttcaggatattgataatgagacggactgggaactggctgaaatgaaatatcgtttattgaaagagaaaggcagattgtaaaatgaaaataggaatacgggagattggagggggacaacctgcatatatcatagctgaaatgtcagcgaatcatgcaggcgatatcagcagagcgaaagagatcattcatgcggcaaaagaggctggtgcggactgtattaaaattcagacgtatacaccggatactttgacaattgactgcgataattcctattttcacatttcagatggaacctggaatggcgaaaatctgtatcagctttatcagaaagcctatacaccgtgggaatggcagaaagaattgtttgaggaagcaaaaaaagcagaaattgattttttttctactccatttgacaatacatccgttgactttctggaagaaatcggcattggattttacaaaattgcatcttttgaattggtggatattccactgattgagtatgttgcctcaacgggaaaaccaatgattttatcgaccggtatggcaactcttgcagaaattgatgaagccgtggaggccgtgaaaaagcagggaaatcataattttgccctgcttcgttgtgcaagtgcatatccggcaattacagacgagatgaatctcagaaccatgcagaatatgggggatacatttggtgtgccatatgggctgtctgatcattccatgggttctgtgggggcagtgacagcagttgctctgggcgcttctattatagagaaacatttttgcttggatcgttccattgaaaatccggattctacattttctatgaatcccatggagtttaaacagatggtgcatgatattcgacaggcagaaagggcgatcggttcagtaaaatatggaccatcggagcaggaaaaaaataacctgcaattcagacggtcaattttctgcgtgaaagatatccaggaaggcgaaaaactgaccgaagagaatatccgaattatccgaccagggtatggactcgcacccaaattttataaagatgttttaggacagacagcattggaggatatccagaaaggaacacctcttgcttttgaaatgatcggaaaataaaatactggagaatggaatggggcaatatttaagaaaagcgacaattgaagacagagatttgctttttcaatgggcaaatgatccattggttagaaaaaattctttttctactgcggaaatagcttatgaagaacatgtggactggtacaacagagtcttggatagagaagactgtatacagtatatttacatggatggtgagtacccggttggccaggccagaattaccttaaacggtgattcggcagagattggatatagtatttgtgaggaaatgagatcgcgcggatatggacagaaattactggctttgatcagtgaaaaagtattgaaagaatttccggatatcagtacaatatttggagaggtaaaaccggaaaattatgcttcgcaaaatgcattcctgcatgctggatatacagaaacttatcgtgtttttcaaatggtaagagatggggaacatgggaaatgatatatatcagagcagatatgaacatgcagattgcaacaggtcatatgatgagatgcctgtcaattgcagatgcattaagcagtatggaaaaaagtgtgacatttatccttgcagatgataaggcgctcagcttattaaagcaacgcggttattatgccattgtcttgcacacagattggaacaatatggaaggagagcttccagctttaaggaaggttattacagaaaatcagattgataaaatgctgatcgacagttatcaggtcacagaaaagtatctgaaagaattaagtagatttgtgaagatcgtctatatggatgatctgaatgaatttgattatccggttgatgctattatttgttatgcaaactactggaaaaagtttaactatccaatagaacaggtagaaaagcattattttgtgggaacaaaatatgttcccttgaagtcagttttctggaactgcgggaaaaaagtaatagcggaacaaccagaaaagcttctggtgttaacaggtggaagtgatccttatcatgtttctgaacttattttgaattgtattgatctgtataaatttcgaaatattgatgtcatttgtggaatgtataatacagattacagaagactggtaaagcattataaaaaatatgtaaatatcagatttcatcaggcagtaaacaacatagaagcttatatgcagaatgcagatattgcaatttcagcaggtggaacaacattatatgagttatgtgcttgtggaacgccaacgatttcttattcatttgctgataatcaatggtacaatgtcagacagttcgaggaagatggagtaattgattatgcaggtgatgccagagtagatgatatagttggaaatataatgttttatttagaaaaatatagagcagattttcaattgcgtaagagcagatctgagagaatgcaaaaaatggtagatggaaaaggcgcgacacgaattgctaagatattgatatatgaagaatagagtatactagggagaaatgaacatgtataaaacagaacaggaaaatttttggaagggtacatttggagatgattatgtaagcaggaatacggaggagacatgcttaagtggaaaaattgctttttggagtaatattttatctaagaccagtggtgttcaaacatgtatagaatatggttctaatattggattaaatcttaaggcaattaaaatgttacatccacagatgaagttaaatgctgttgaaataaatgatacagcagtggaggttatgaagaacgatccgaatttgccagtgaaaatatttcatgattcaatattagatgttgagataaatgatatatatgatttggcgtttacgatgggagtattaattcatatcaatccgaatgaattaaaaactgtttatgaaaaattgtatacatcgtcgaaaaaatatatgctgattgcagagtactataatccaagtccagtggaaattccctatagaggaaataaagagcgtttatttaaaagggattttgcgggagaatttttggatatgtttccagattgtaaattagaagattatggatttgtttatcatagggataataatttcccattggatgatataacatggtttttaatgaaaaaagaacaatagaaatcgaggcagatggaaaatgataccatacggaagacagacaatagaagaggatgatatacaggcagttgtagatgtattaagatcagactatctgacaacaggtccgaagattgcagaatttgaaaaaatggttgcagattatgttggagcaaaatatgctgttgcaatctccaatggaacatcggcacttcatgcggcgtgttatgcagcaggaataaaatcaggagatgaagtaattacaactccattaacctttgctgcatcagcaaattgtgtgttatattgtggtggaactccggtatttgcagatgttgatccgaaaacttataatattgatccggaagatatcagaagaaagattactgataagacgaaagcgattattgctgttcaccttgcaggacagccttgcgatatggatgagatccataagattgcagatgaacatcatttgattgtcattgaagatggtgcgcatgcacttggttcggtatataaaggaaagaaagttggaagtttatctgatatgacaacgtttagttttcatccggtaaagccaatcacaaccggcgagggtggaatgattgttaccgataatgaagaattttatcagaaaatgatattattccgtagccatgggattacaagagatgaaaagctgatgacacgaaatgatggtccgtggttttatcagcaactggatttgggatttaattatcggattaccgatattcaatgcgcattgggatgtagccaaatgaaaaagctggatcgttttttggcacggcgcaaggaaattgtagcgcggtataatgaggcattttctgattgtgaaaatattattaccccgtatcaactgccgaaaacagaaagtggatggcacctgtatatcattcaggttaagaactgcgatagaagaaaggtgtttgaacagcttcggaatgaggggatcgcggtaaatgttcattacattccagtttatatgcatccgtattaccaggagcatggatatgctgatgtgcattgtaacaatgcagaagaagtttattcccatataatcagtcttccactctatccgacacttacaaaggaagaacaggagtatgtgattaaaatggtaatagatattgcacattaaaaaaattaactcaactttcccaccagtaaatctggtgtaaatacttgattttcaagcaaaacaattaaacaaattcgtgtattgacataaaaaagcacctaatctttggtataataaagtcaccacaacaataaaaaccaagaaaggtgccaactttatgataaaccaaatgaacacaaatgaccataccgaaaatcaattttttcatgcattaaaggaacttcagattgcaaaactgcttcgcagggccaatatcacgaaaacctgtggtgtttctgcttatgaagtattccagtttttgttgctgctggtatttcagggcaaaaacctgttccggtttctgaattccaaacacaaagaacaagcagtttcaaaaaacacatactaccggttcctgaatgaagtatcctacaactggagccggtttctgatgctccttgcggtaaaagtgacttctgcttttgaccgactcacgcgtccggaacgggtaaacgtccttatcctggacgattccgtaattaagcgtaaccgcagtaaaaaaatggaactgctggcacgcgtctatgaccatgtggaacataaattccagaaaggttttaccctgcttacgcttggctggtcagatggatacagctttgtcccgacaggttttaatctgctgtcttcagcctctgaaagcaaccgttataatgcagtttcggatagcattgaccaccgaacaaacggttataaagttcggaaggcaagtatgatgcacaaaacagatgttgcggtccagcttatccggaatgtgctcactgctggaataaaggctgattacgtgcttatggatacctggtttaccacagagccaatgctcaaagagattctggatacaggaatccatgcaatcggcatggtaaagcagctgcaacagcgttatacctataatggcagacaatatacgcttccgggattgaaaaaattcgttgatttttccggtgccagaaatatctttggttcccttgttgtcacaaccaaaaccgggattccggttaagattgtatttgtacgcaaccgtaataaaaaaagtgaatgtctctatctcctgggcacggatacttcattgaatgatgcagaaattgtacgtatttatgggaaccgttggagcgttatgccgatatctgcataattgaccagcggagattgtaacagtattttatatcgtccggtgtaaagtcttcttcggaaagtgtagtgataatattttcaaaaacaccatcggatacttcaacgcggacgattcttagtttcagcagatattcatcggaaatatcagctggattaagatagtcgaaagctatgtttttacaaatatagcggtattgtgattctttttcgggatgtttatgtttctttttagattgtattctggtcagaatcagctctatggttgtatccagtttgtcaggaagagtcccgacgccaagaaaacgctgtacattcaaatccttagcacgaattaaaaaatcaacattattttcgattgcatgggcaaaaacgttgtaactggaaaatcccctgtcagcaatgaaaatggggaaccccccataggcataccgatccataagattgcagatagcttgaaactcatttttaagacgctcaggctggacttctaaatcaaggtaccgcttagaacatacctcatataaagaaatggtatgaaccatattaaaaccggataccgatttaccatttggttcgtggaaagtatctgcatctttaagatttctggcaatgttaaattcagaaccatcacacgcaataagatagtattttccgcgaaatttttctaaggggaatttaaggttaaattccttgagaaggtgacggaatgcagaaacggaaagtttggaacgttgttgataaaaagcagagccagtaggaactgaggaatcatactcaaaaaatttgagaagttcatgatttaggcttccgctttccatagaaatgatcagatgcatcattttcttaaaatcaagtttgcgtttgcggataaaatccttatctggattttttacaaaagaagaaagtgagcgggacatctcatcaataatgtccaaaagtgtagttttgacaatttcaggaaatgtcataggtaaacctccttgaatcagaatgaaatatagttctaattcaagggccgctctcgttaccttaaaaatatatcagcaacgagagcggccgcacattttgattgatgtgtcaactataatttataaatttttgttagaggtttgcctcatagtgaaccaataagcttaactaagtgacattgaccatcccctgtctgcccgcattacccaggaaatggtagacgagtggctcatttattatccttatactgtcaacagtaaatccgtcttcctctctctcctgcgggagtacacgaaatacctgaacttccttggatatgatgattatataccggatgacgtctatgtagtaaagcgcatagctttcaatccgtacctgtttacggatgatgaactctccgggttatttaaaatgattgactcatatgttggcaaaacctgtgggaaaagatatctgccagagattgtgcttcctgtgtatagccggttactttactgctgtggtcttcgcccacaggaaccacctgcgatacgaacagaggatgtaaacctgattacaggagacgtttatatacggcagtccaagaggcacaaggatcggcacatcattatgtcagaggatatgcgcacgctctgtcagaaatacgattccgtagcaggaaagaggcaatggttcttttaaaaatgggacggcacaccatacgaagcatcgtggtacaaccagataaggaggaacctgatctcaaagagtggcatttcatggaaggggactccaagaccttatgatctgcggcacgcttttgcttcgcgtaatataatccgctggataaacaatgggaaggacgtgatggaattattgccgtacctttcggcatatatggggcattcagaactcacatcaacgctttattatatccaccttcttccagagaatctgcgcaagtccaaagctgtaaactgggctctcctttcccaggtttatggaaagggggttccggaagatgaggattaaagctaaagatccacgccttgtatcgcttatgggtgaatttatgagaatctaccttccgggtgtcaggaatcgcgataaagacacaattgactcgtacagatatagcataaatctgtttgtgacataccttgaatcaaaacaaaaggtgactgtcctaacgatgcagtcatctgacttcagccagaaaaacatagtagaattcatggcttggccgaaatctgaacgcaataacgtggcatcgaccataaaccatcgcctatcagatctacggggattctgcaagtacctttataaaaagaacgctatctcccttgatgcgtatgagacaatccgcgagataagcgatgttgatgatgaaaggattctcgattttacatggctttcagttaatgatgtgtacctggttcttaaaagtacagatagcaatcgtgaagctgtaagagatcgttttctcctgtcgcttctgtatgaaagcggtgcacggataaatgaggtattgtcactaaaactccttgatattaaagcgacatccaacggggaggctgatgtccatttctacggaaaaggaaagaaacataggattacacccttatccaaggaaatatggagccggtttgaagattactgcgaaaaatatcatccagacaagacttcggagaatctgatgttttattctttccgaaatggccggagaaacaaaatgtccagtgataatgtcagccgtatacttgcaggatgtgaaacagaggttcgcaaaagcaatccggatctagtccatctgcattcgcatcttttcagaaggacgagggcaatgcacctgtatcaggcgggggtgcctctccctactatatctgaatggcttggtcattcgaatatagaaacgactcgtttctacgctaaggttactgaagaaatgaagagggaagcactgcataagcttagcgatagcgacagatccgtctttaaggatgatgtggtgttcaagtatgccaatgacgaagatgctatcaagcggctttgtggattaaaataaatgccgatagtttattaaccatgcctgatattgggtcaggcatggaatcttacagaaattttatcggcatttctaaaatatcggcatatggtcaattgaatgctttttcaaggcatcaaaatcttttttgaaattaggttcgggattccagagccgtaattatggtgcaatggtaagccatacaaccattgtatttacacgatatatcattctggaatggctccgtcggaaccagaatgacgaaaaaacatatggtgaactgtttttcatgtactgtgaagatatccaggacatggatttaaccaatgcactgcggagccttatggctctgtttgtggaacatatatcaacgttttctgcagatatcacatttgtactgaaaagtaaagtaaccgaatggattgcttcccaaaccgcatttattcaggctttattcgggaatatctgctgggaaagtttagtcaaatataattcgttaacccaacatttattttagagcctaattttttatgaaattttcatgcagtgagcgtttcctaaaagaaactatatttgtaatgaccccaaagcctgcttttcaatcatttaaggatagggtataatatatgaaaaaaggcaaagacagggggtgactgcaaatgtctgcaaatatagcaatcggaatacaggacttctccacattaattgaaaatcattatttttatgttgataaaacggattttataaaggaatggtgggattgtggggacagtgttactctgatcacaagaccaagacgttttggtaaaactttgaccatgagtatggtagaacagttcttttccgtggaatattccggacgttcggatctgtttgaggatttaaaaatctgggaggataagaagtaccgtaatatacagggaacgtatccggtcattagcctgtcttttgcaaatgtgaaggaacccacgtatcagctggcagaaaaaaagatctgtgaattaattgcgcagctttatgtcaaatacgattttataacggaaagtggaaagctacgggatacggaagtaaagttgtataaaaaaatcatgactgatatggagtatgtagatgcaacactttctttatattatctgtcaggatttttgtataaatattacggtaaaaaagtaattattctgttagatgaatatgacacgccaatgcaggaagcttttgtagatggatactgggagcagcttgtgacattcacaagaagtctgtttaacgcgacatttaagaccaatccggcattagagcgtggaattatgacaggaattacgagggtcagtaaggaatccattttttcagacctgaataatttaaaagtggttactacaacatccaatgaatatgctgcatcctttggttttacggagcaggaagtgttttctgcgctagaaggtttcggactggaaaacgaaaaaaatgaggtaaaaagatggtatgacggatttatttttggaacccacaaagatatctataatccgtggtcgattttaaattatctggatgcaaagcagtatacaacctattgggcaaacacaagcgcaaatagtcttgtcggaaaattggttcgtgaaggaaaccgcctgatcaaagaaaaatttgaaaaactattatgtggggaatgtatctggtcggaaatagatgaacagattgtatacaatcaactggatggcaatgaaaaggcggtatggagccttttactcgcaggcggatatttaaaggttttgtcttatgaaaaatatcaggatattccagaaggaacggaaccgaaatatcagcttgcacttaccaatcttgaagtaaagcttatgtttcagagaatgattcacgattggtttgccccggtacagccggattacaacgattttgttaaggcaatggttgctggggatgtggatgcgatgaatgaatatatgaaccgtatagcattacagacattcagctattttgataccggagaccgggcttccggggctgaaccggaacgtttttatcacgggtttgttttaggtctgctggttgatttgcgggacaggtattatctgaggtcgaatcgggaaagcggctttggcagatatgatattatgttggagccaaaacatccgggaaaggataatgctgtgattctggaatttaaagtacgaagcgcaagaaagggaaaaagtctcgaagagaccgcgcagtctgcaattgcacagatcagggaacgaaaatacagtgaagaactaaaaatgaaagggattacagatagtcagatcaaagaatatggagttgcgtttgaaggtaagaccgtgttgattgtggattgagctggtaaatattgtctggttggtgcgcctgaagggcatagcaagggatactacaccagcatcccaagcgttcccgccacaatcagtaccagccccccggcttctttttttccaagtttctcatgaaatacaagataagaaaacagaatggtaaccagaatactcagcttatcgatcggcacaacgacacttgccagaccatcctgcaatgcgcggtaatagcacagccaggaagcaccggtggcaagaccggacaggcagataaagccaagttccctgtgatcaatcgtgcgcacgctgtcctgctttttcgtgacaaacacgacaatccatgccatgatcagcacgacgatggtacggatggcagttcccagattggaatcaatgtcttcaatgccgacttttcccagaatagaagtcaggctggcaaagacggcagagccaagcgcgtagaagaaccagctccagccttttttcccggaattctcagaagaagttccctttttcgtgatcatcaggtaggttcccgcgccgatcagcaccacgcatagaagtttcagtgggctgatgctctcatgcaggaagagaaaagcgagaagaatggagaggatggcactcgatttatcgacagacaccaccttatccacatctccgatctgcagtgcacggaagtagcacagccaggaagcaccggtggcaagtccggacaggatcagaaatgtccaggttttggcagaaacacttccgatgccgtgttgtgccccgaccagaaataccatgatccatgaaaaaataagtacaataatggtacggatcgccgtagctacattggaatcggtatttttgataccgcatttcgccagtatggaagtcagtccggcgaacagagctgacccaaatgcaaatagaatccacatatacaatttcctccctgggacaagcgtaaaatgttttggggcatttgtcaaaacttttttcttgtgatatgataattttatctttttcagaggtgacagaatgtttgaaaaaaaacagatcatatacagtgaaacacagggagtctgtcaggtagaaaatattgtttcgctctccgcatcacgtagggagcgcaaaattccgtactatgtgctgcgcccggtattcgacaaatccagagtatcttatattccggtagaaaaccatcaggtaaaactgcgggagttgtttaccagggaagaggcagaggcacttcagggaacggaagaaatgaaaaaagatgaaaaactgagacaggccgtggagtatgtattaggaaaaaaggagggataggatggcacagcagcagccacagcaggcaatacataaatttgtacttggaaataaagaacttgaaggaaagacagcggaattccagtatgacaaaggctggtacagcattacggatattgtaggggaggaacgcaacgtaatctacaaatcccgcaatgcgcaggaagcctatatgaaatggaacgtatatatcggtcgcaaaaaagagagaccgtcatccggcaaaaacagcgatgcggatcatggaagccgtgcggatggaaacagagcaaacgattcccgtgagcatcggagccgtgatttccgcgaaaagcgtgacatgacggatcggcgtggaaataaccggggacgtcattgacatataaaaacagcaccgggcaggtgaagaccgcggtgctgtttttgtttaaaaagtgagcggagagcatgggattcgaacccacgttgcgtctattcgacgcaaaccgcatttcgagtgcggcaccttcgacctctcggacaactctcccttgaaattcatctccgatgaatttcctacgtacatcgcttccgcggagcggaactctcatgcgatgtgctccttgaggtatagcgtaagctatatctcctacgtacatcgcttccgcggagcggaactctcatgcgatgtgctccttaatagtatacagaatttacatacatttttcaagtcgcttatcttgtgaacggacaaaaattatactataatacaaatgtgtatgtgaaaacatttggtacacaataagagaatatgcaggaggaaacgtgcatgatgaagatcggaatgcttaccagcggcggagactgccaggctttaaatgcagccatgcgtggtgttgtaaaaggacttactacgaatgtagacgaactggagatttatggatttgaaaatgggtacaaagggctgatctatgaacagtacagaattcttacagcctcggatttttccggaatccttaccagaggtggaacgattctcggatcttcccgccagccattcaaacagatgcgtgtgccggatgaaaacggtctggacaaggtagaggccatgaagtccacataccgtaagctcggactcgactgtctagttatcttaggtggtaacgggacacagaagacagccaatctgcttcgtgaggaaggactcaatattattcatcttccaaagaccattgacaatgatatttacggaacagatgtgacattcggttttcagagtgcaattaatatagcgacagagaccatcgattgcatccatacaacggctgcttcccacaaccgtgtatttattgtagaggtgatgggacacaaagtaggatggcttaccctgtatgcaggagtggcaggcggtgccgacattattctgctcccggagattccgtatgatattgataaggtcgtggatgcgattcataagcgtacaaaagacggaaaaggatttacgattcttgcagttgcagaaggtgcaatctccaaagacgatgcacagcttaccaagaagcagtacaaggcaaaagttgcatcccgcaggtatccatcggtttcttatgagattgcagatcagattcaggagaaatgcggtgtggaagtccgcgttgcggttccgggccacacacagcgtggcggcagtccgtgtccatacgacagagtattatgtacccgtcttggatctgccgctgcccaagcaattatggatggaaaatttggctgcatgatcgccatgatcaacaacaagaccaaatgtgtgccgcttggagaggtggcaggcaagttaaagacggttgatccggacagtcagatgattcaggaggcaaaacggatcggtatcagttttggagattaaatttcctgatatccggcaaaaaggagaagaaaaatgtcttacacggctttataccgtaagttccgtccgcaggaattcgaagatgtcaaaggacaggaacacattgttacaacattaaagaaccagatcaaagccgatcgcataggacatgcttatttgttttgcggtacccggggtaccggaaagacgacagttgcaaagatttttgcaaaagcagtaaattgtgaacacccggtagacggaagtccctgtggaaaatgccctgcatgtcagggcattgccgccgggacttctatgaatgtcatagagattgatgcggcatcgaacaacggcgtggacaatatccggcagatccgggaagaagtatcttaccgcccgacagagggaaaatataaggtttacattattgatgaggtgcatatgctgtcggcaggcgcattcaacgcgctgctcaagacgctggaggagccgccggcatatgtgatttttattcttgcgacaacggaagcacacaagatcccgattacaattctgtcccgctgccagagatatgattttcaccggatttccattgataccattaccgatcgtctggcggaactgatgcgtaccgaacaggtggatgtcgaggagcgcgcactgcgttatgtggcaaaagccggggacggttcgatgcgtgatgcgctgagtctgctcgaccagtgtattgcttttcatctgggggaaaaactcacctatgaaaatgtgctggaagtgctcggtgcagtggatacggaagtgttttccgcactgttgcgccaggtgctggcaaaagatgtgaccggtgccatccggacggtggatcatttggtagatcagggacgggaactaggacagatggtgaacgattttacctggtacatgagaaatcttttgctcatccagagtgcggatgacatggaggaagtgctggatatgtcggcagatcatctggcagccctgaaagaagaggcacagatggtggagccggaaacactgatccggtatatccggattttctcggaactgtccagccagatccggtatgcggcacagaagcgcatcctgctggagattgcaattatcaagctttgccgtccgcagatggaaaaagatctgtcggcactcaatgagcgtatggatgatatggagcagaaattagaaagcggggcatttgtttcggcagcaccacaaagtgcagaagttccggcagcaggtggcacacaggctccggaggcacaggctcaggagaaaacacagcttcccaaagccattccggaggacattaaacaggtgatgaacaactggcggtcggtcatttcggagatgggaggcatcaccagacagtatttgaatcaggcggtgccgacgctcggaccggcgggagaactgctcctggtgtttgacgatgccaacgctttttcctatctaagcgacaataaggcagggtgtattgatcatttgaaagaaatgattgcgcagcggtgtgcaaagcaggtagaagtgcagctccgcttaaatgaaggaggacgcagcgcagccaatacggtaccggatttgcggcaattaatcaattttgatattgaggaagagaacttctaatggtatgataatacaagattcgtaaataactgaaattagaaagcaggaggaccccacatggcaaaaagaggtggattccctggcggtatgccgggaaatatggcgaatattatgaaacaggcgcagaagatgcaaaagcagatggaagaggcgcagaagaatttagaggaacaggaagttacggcagcagcaggaggcggagccgtggaagtgacggtttccggcaagcatgaggtgacaaaggtaaaactggcagaagaagtagtggatccggatgatattgagatgcttgaggatctcatcatggcagcaaccaacgaggcaatgcgtaaaatcgatgaagcttcccagcagtccatgtcacagattaccggtgcattgggcggaggacttccgttctaaatatggattattacagtcatgagattgcgaaattgattgaggaattgtctgcacttcccggaatcggagccaaatctgcgcagcggctggcatttcatattttaaatatgccgcaggaccacgtggatgcactggcctcggcgattgtttcggcaaagaaaaacgtaaaatactgtaagtgctgttttaacctgacagatcaggaaatctgtccgatctgcagtgatacttccagagatcacaagacgattatggtagtggagaatacccgtgatctggttgcatatgaaaagaccggaaaatacaatggagtctatcatgtgctgcacggtgctatttccccgatgcttggaatcggaccgaacgatatccgcttaaaagaactcatggttcgtctggagcaggatgtggatgaagtgattattgctacaaattccagcttagaaggcgagacgacagccatgtatatcagtaaactgatcaagccgaccgggattaaagtgacacggattgccagtggagtaccggttggcggagatctggaatatattgacgaagtgactctcctgcgggcattgcagggaagaacggaattataatacaccaccattttaagaggaggaaagaataaataatgaataatttagaattggaaaaacttgcgaatgaaatccgcaagagcattgtaacggcagtgcacagcgcaaaatccggtcatccgggcggatcgctgtcttcggcagatatttttacatatctgtatttcgaagagatgaatattgatccaaagaacccgaagatggaggatcgtgaccgttttgtattgtccaaaggacatgtagcaccggcttattattccacacttgcagagcgcggatttttcccgaaggaagatcttgtgacactgcgccatacaggttcgtatctgcagggacatccggatatgaagcatattcctggcgttgatatgtccagtggatctttggggcagggagtttctgctgcagtaggtatggcagcagccggaaaatttgatcacaaggactatcgtgtatacaccctgaccggagatggtgagattcaggagggacagatctgggaggctgctatgtgggcaggacaccggaagctggacaatctggtagtgattgtagacaataataatctgcagattgatggggagattgacaaagtatgttctccgtatccgattgataagaagtttgaggcatttaatttccacacgatcgtgattgatggaaatgatttcgaccagatccgtgcagcatttgaggaagcgaagaagaccaaaggtcagccgactgccattattgcaaagaccatcaaaggaaagggagtttcctttatggagaatgaagccggatggcatggaaaagctccgaatgacgagcagtacgaaatcgctatgaaagatcttgagaaagcaggtgaagcattatgtcagaagtaaagaaaattgcaaccagagacagctatggaaacgcattggtagaacttggaaaagagcatgagaatctcatcgtgctcgacgcagatctggcaggtgctaccaaaacctgtattttccagaaagaatttccggagcgccattgggactgcggtatcgcagagtgcaacatgacaggtattgctgcaggattatctacctgtgggaaagttccgtttatcagttcttttgcaatgtttgcagctggacgtaactatgagcaggttcgcaactccatcggatatccgcatctgaatgtaaagatcggagctacccatgcaggaatttcggtcggagaagacggagctacccatcagtgtctggaggatctggctctgatgcgtgagattcctggtatggtagtgatcaacccgtcggatgatgtggaagcacgcgcagcagtacatgcagcatatgatcatgtgggaccggtgtatcttcggtttggacgtctggcagtgccggtgatcaatgacagaccggattacaagtttgagatcggaaaaggaatcgtattaaaagaaggtacggatgtaaccatttttgcgacaggactggaagtgtcagagtccttagaagctgcaaagatgctggagaaagatggaatttctgcagaagtaatcaatatccataccatcaagccgattgacgaggaactggttgttgcatctgcaacaaagacgaagaaagtcgtaaccgttgaggaacattccgtaatcggtggacttggaagcgcggtagcggaagtattgtgtgaaaaggcaccgacaaagatgatgcgtatcggcgtgaatgaccggtttggagaatccggaccggcggttgagctgattcataaatatgaactggacgcagaaggaatttacaaaaaagtaaaagcttttgcaaaataatacagcaagtacaaaggaggctgtcgtatcgaaggatatggcagtctttttttgcctgaagtctggaaatatgtccggtagtgtcgtacgatttttttcatgcctgtcaggtttttccaaaattctaccggatggtggtgatactatattctggaaaaacggataaggaggcaggatatgatagatattgcagaaggaccgggacgtgacctgaaaaatatcagacagatcggaacaccggcagagggggatcggatttacatagaaaatgcggcgtatgccagggtgcatgaagaaacttatgaggagcggagagtgtttatctttatggggcatacagagtgcgagcagggtgtatatatgacctttgtagaggctgccattccggtaagggatatggaattttcacagaatctgccgagatggggaacgcatgcgtggtcggatgtattccgtgagattaagagatcttatgagaattccattattgtcggatgggcattggattgtaaaggatatccaccacgcctgacagcagaactggaagctatccacagagaacagttcggaggtgcacatcaggttcttttccttatggacagtatggagggggaagaatacttttatctgcataaaggcaaccggctgcaaccgaaaaacgggttttatatctattatgcaagggaactgcatgagatacggatcccggatgtgacgattgaactgccgagacgtggaacccggcagatgcttccggagattctgacggagagcaaaaaagagaacgaaaaagaagaatgcagcagttcaaagagcgaacgcaaaccaacgtcgtatgcgatggctgccgcaatcgcgttgcttttagttctggccggggtcggaatctggcagcagcgaattcatattccgggtctggagcagaccgtggagacgataggggaaaaaatccgccatgtgtcacaaccggcagaagtcctggtgggaactgaaaaaaatatagtggaagaacagacggagagcgcaaagagtacggaaaccatcagtgaacccatgcagctgataccgattgaagaggttccggcgggagcggtgaaaaaggcagaggaagcggttccttccacacagccggccgaggagaaagaaaaacctgtggcggtagaaaatacacaaaattattatgtggtacagcagggggatacgctgagtgggatctgtaaacaggcatacggatcaatgaaaaaattaaaagagcttgaaaaggcgaatgatctggaagattcggatgatatcagggttggacagaaattattacttccgtaacggggattgcaatgctataatgatagaaacgtaagcgaaaaggagaaaaatcggtggctgaaaaaacggaatttaaaaccgtagagacaagtcaggaagacctggaggaactggaagaaaaaatcaggagacacaggcataaaatagcccgcaggacggcacttgtgatcgttactgttgtagcagcagtgattttcgtagaactttggtctgcacttcgcacatattcaggatttgaggtgcaggcatcggcggagaggaaggacagtgcggcaacgggatataagatgttccagggaaaaatactggaatatgataatgacggaatcgtgtgtcacgatacagatgaccggctgatctggaaccagtcttatgaaatgactacgccggaactttccgtgtgtgaacagtatcttgcagtttatgatcgtggagggacatttatttatatcatgtcggatcgcggactggtaaagaaaatcgaaacggcaacaccgattgaacgtgtatgtgttgcccgtcagggaacggtggctgtgctgatgaaggaggatgatgtctcgtatgtacggctttatgacaaaaagggacaggaacttgccagcggtgaattttatcaggaaaaaggaagttttcctgtagatattgcgctggctccggatgcgcagaaactggcagtagatatgctcgacgtgacaaagggcaaaacctgttccacggttactttctataactttggttcggttgggcagaatgaaatcgacaacaatgtgggaacgtacagttacaaaaatacgatgatatcggaactggtttataccgaatccggaaaacttctcgcgatcagcgatgccggactgatctggtttgacggagcacaaaaacctgcgccgaaaaaacagataaagtttgaacgggagatacagagtgtcttctataataataaatatgtcggtatttcatacagcgataccaaaaaagaaaacagctggcacataaaagtctatgacatgaatggtaaaacggtcatggagaatgatacagagatcgcatacaacagaatcgagctcctcgataataatgaaatatgtgtccgggatgattataactgtgaattgtttaccatacacagcatccgtaaattccgttatacgtttgaccggcagctttataacgtattgtcgggatcggatggtcagaattatacattggtattaaacggagaaatagaagaggtacgattacaatgaactggttattgatactggttgtattacttgttgccggaaatattgtctggggattcttccgtggtttcctgcgtgtggtttattcaatggctgcctggatactgattctgttttttgttacgtttgcaacgccgtatgttgcagactggatgacagaacacacaggcctggataccagaattgaaaagaattgcaaagagaaattgcaaaatgccgtggcaggggaagaaaaaagtacagaagaacaaaacacgcaggagcagaaagatctcagcggtctgggaatgaaactgccggcaaacgtatggaaccagataggggacacacataaacttgcggatggctggatggagcaaagcggactgtataatacgattgcgtcaaaagcatcatcccttgccatgaaagcgattgcatttgttattgttatgctgattacggtgatcgcctttcatctgattgccactgcgattgatctggtggcaaaactgcccgtaataggagaagtaaatcatatgcttgggggaattgccggattgatcaaagggctgttgctggtatggctggtatttgcgtttgcagcaatgggggcagcgacagaagccgggagtgttgtgattgaagcggtatatcagtcgggaattctgcaatggctatatgaaaataatttaatactgacgattctgctttcgtttttatgattgaattgtggtttgtaagcacccagggaacaatatcttgtggtgcttatatttttgcaaataaaatgtaaagtttttgttgactttaggttgtctgcgtgatattatatctaagctgactcgtgacgaggacactgatacaggcactggcaggaagctgagtgatggttggtggtcatgatgatgaaaaaagttgttgacaaacaatgacaaacatgataagatatcagagttgtcgcgtttgagagataacaaagaaaaataaaaaagttgttgacaacgacttgaagatatgataaaatatacaagctgttggaactgctaaagaagcgttcccctgcggattgtctttctgtgtttccatatcaatcttgaaaagctcaatcaaagtgtccgttactttcggtgtatctgatactttcaaggttgctgtctttccagcttcaacctttaaggaatatacagttttatccactttatatcctgctggtgcggataattccttgatatagactgtgcctgcttttacctctacaatatctgtatttccgttttcatcagtcgtaagggtggcaagctgtttcgtgcagtccttatcagaaaagacaccgtatgtcgcaccagcgacagagtaattcccgttaccgtctgtaatgctggtattactggaagtcttttgcagtttcgcatttccgacattcagcttcgcccagaattgtcccaattcctgcccctcgccagagtagatataaccgccacattcatagcgtcccttattctctttgacaaaggcttttgcaccagcgaaaacttcgtcctgcgtagcctttggaatttcatcataagaagctcgcacgttatcacattgccagccaagatgtacgctcaatctctgccagactacaagctgtcttaaaaggtaagcgtgatttttgcttattccgctgtggctgtctgtgtactgttttacatattcgatagataaggcaacgtcgcttatctggtcgatactcatgcgtgagcttgcgtcagctctggtcttgtagccattcttaaaatctgtattgatgtcgatacagtaagcgtcctcgccctcaacggtcaaatgtccctcattaaaggtagaaccaatcgaaccgtcattcattactttttcaacgataccgacacgctcttttgactccgtccagtattgcttactttctgcatgaacgggtgtagtcggtaaagcagtaacgacagttgcaagagctaagaagcccgtacacaatcgtttccatgtctttttcataaatctaatgctcctttcattttgggtaataaaatagccgtccaataagaacggctggaaatagaaaaggaacgtcatgttaggcgttccatagtctatgaaatattcaattttttatactgatgtgttactcatcaaaatctcaaatcaaggttatttgacaccaattttgacaccaaatttttgtatattgacgatttttgatgaaatgtgataaattcataaaacccgtgaaaagcctgtaaataggcactttacggcactctatgaactaagacaaaagctacgctgtaataacaagtatcgagtgctaattcttttgtgaagattttgtgaagtcttaattttagtcctgttttcctattgcgcatatgtttcttccatgctatattttctttacacatttcgaatttgcagctaaatttatataccgctgcatttcaccggatatttcatccgttttttccatgtgtacgaaacaattaaatattggagaggaatttcgtgcagagcaaaaattcagttattattttattattgtttattattgtttttattttcagatattgaaagctggggggcttccatgttacaatcttgatagaagaacagccgctatatcacacgttttcctctccgccactacaaaggagaagaaaatgtacaagagcaaaaagttcgaagaccttaccattagtgatgattttatgtttgggattgttatgcgcgatcccaaatattgtaaaccgtttctggaaactatactgaatattaagatttcacgcagttgaaacaaagttttgtgatctttgtctgcacctttgatccgttccatatcggcaggcatgtgtatacttttgaaaaccgctgcgtggaagatccgaatctgcctcttaacgatggcacacagaaaatcattttaaatacgaaaggaatttttgatgatgttcggccggaactgaaacggctgcttaactttattgatggcagacagccggaagattcttttacacaagatctctccaaggctgtggaatctgccaagcgcaatgagaaatggaggcatgactacatgacgctgcaaatggcttatgacgagaaataccgcgaggggctggaaactggcattcagcagggcattgaacgaggcattgaacaaggcattgaacaaggcattacaacatctgcccatcgtatgctttcctccggtaaatattcggattctgaaatttctgaaattaccggactttccgtggaacaaattcaggctttaaagaattccgcaaaataaactcttattatttttaattcaatactttataattcaagaataatcttgaggttattgtcctgtacgcttgctcctacattaccatcaagagccagaacgagagccttaactaccgcaagccccacccccgtacttccatcgtgtcgtgaggtatcccctgtataaaagcggtcaaacagccggttaccatcaatttgcaagctgtcactcactggattttccatcataaaccggataccgccatccgatttctgcataagtgttatttttatgttccctgccgaatacttcattgcatttgtcagcaggttttgcaaaatccgctctaccatattccggtctgaatatatgtagatggaataatccggtagttttatttccggtatgatattctttttttctaatgccggtgcatgttccgttatcagatctatgagcatgttggaaaaattaaacgtttctttactgggaacggtctgctgttcctctaaaacagaaaggtcataaaatgcttccaccagttccttcattttttctgctttacgcaggacaactgcgatgcgtttggcttgcgccggctctaaatcttctttttgtaacaattgtaaatgaccaagaataaccgttagcggcgtacgcagatcatgcgatatatttgcaacagattcttttaaatgttcttcatgacgtaaggttttcgctacggcctgtctctgcccgatattataaagattcagtatagctgccaggtgttctaaatctttatccatcagggaaatgtctatcatctgtccggaatttccacgattccattccttcacctgaccggaaagattacgaatttgttttttcagctgtatatgtcggaataataatatcaggaatcccactgccagaagcaataaaaaccattttatttcagacatctttcctccatctatttcaagtcacatttacgaaattttatccacgaaagcaatatcagtatgcccgaccatatcacccctgccagaatagcagccggctgaaaaaatgtgttcctgctgacaacgacccggatctgataaaccggtaaaaacgctaccggcaattgcagcatcattccatatccgagataaagactaagtgcaaaaataataattgccgtaacagaagctgctctcacaacatcttgcaaataacagcaaattaagattgcaatcagaaagatcccgctatttaacagaagcgaataaacgattgcttttgttacattataaaaaaataccccaccatcttccataccaaactttccaaattctctgatacatcctgcaaccggatacacaagcgccatgatatgaaaagcgatcagataggatatgattttacccgtaaaaattttgcttctggaatgtccggcactgacttcgagcgttatggttctcccggaaaattcctgtccgaaactcaaagcaagaagccccgaaataatgataaggagaaacgtagaatcatacaccattccgttaaaaatatctgcaagggaagatgcctttcctcctgccggtcccataacttccggcacataggtatcggcggtaaaaaagcccagaacaaatattccgatcatcccacaccagtaaacgaaattatgcaaaaactggtatttctccatctttaataatttttccatcctaaacacctcccactatttcaaatctgcatgtaaaaaaatgcgaccggcactgtaatacaaaataaacatccacagaaaatccaggcttaacggaaccgttgtcctgtcaaacttttgtaatgcaattaatcgaagctgtcccatgggcaatattcttatcagactttctgcatgttgcccattcatcaaaaaaatcataagaaaaaacagaaccatggaaactgccagtgtttttcccatatcgcggaaaacaaaagcaagaacaaccggtaatgcacacatggtgattacgacaaacagtatttgaaaagccacagtaaaagtacctgaaatttccggaaatctttctttcataccaaaccggccaatgatttcatgtatcagtaacggaactgtcagaatgaggatgcagccaatctgggataccatgacttttgcccagaatacataacctctcttatgtcctgcagtcagatatgcatttaaggttcttcctcccaaatcatttccaataaacaatgctataaaaacaataatcaggaaataaagaagtggcgtattatataaagatgccataaccagatttgaagtttttcctttgctgtccagcaacaatatactgcttaaaagaaacgtaaagatcccgattccccaaaagtaccagctatgccataatttataccattccgttctcaggagatttgccatcttttgcccctcctattttactcaggaaataatcttccaatgtatcacccgatacaaaaagcccggtaaccaacacatgcgcttctgataaaacagatgcaaccatttccagatcatccagatgatcgtacaaacgaatcgtaccatcgggcatcagcttaaaatgatctgtatgaagattttcttccagaaccatcactgctttctgtacattggttgtctgaatcgcaatatgacgtttgcaccgttcatttaattcatgatcagaaatttcttctataatatttccatgatcaagcagaataaactctgttgccgtttgatacaattcttccaaaatatgactggagaccagaattgtcattccgtattccctgtttagcatttttaataaattcctgacttccacaattccggcagggtccagtccgttaacaggttcatctaaaattaaaaattccggggtattcaaaagagccattgcaattccaaggcgctgccgcatccctaaggaaaaatttcgaaccctcttttttcccgtatcgtttaacccaaccatatccaatgttctttttatcacggttttatccggtatgccacgctgaatacgctgtatttccatattctgatatgcggtcattgcaggaaataatgccggtgtttcgatcatacttccaatccgtttacgctgtttctgtaattccacagtttctgattttccccataaggaaagcgtgccgcttgtcggaaatgcaagtcccgtgaccagtcttaaaaaagtagtcttgccagccccattccgaccgataaaaccataaattttccccttttttatctgcaaatttatgtggtctaatgccagtgtctgcttatactctttcgttaaagaccgggcttctaaaataactgaattcatcttccgaacctcctttaccaaaaacagtataacgaacattcttaaagaattccttaagctgagataagaagacattaaaaaagcataaagccagggaacttttattccttagccttatgcagacgataaccaatgccccagaccgtatctataaattctttatccggacaaaccgcttttaatttgttacgcaaattactgatatgaacattaagcgtattgtcttccacaaaatattctgtattccacacactctgaaaaagatttgactttgagaatactttgtccggatatttcatcagcaattccagaatggcaaattcttttgcggttaaagccaattccgcttccttcaaaaatgccgtattcttttccagatccagacataaatccccgtattgtaaacaggcagccgaacgattttcaaactgtactctgcgcagattgctttcgattctggcaagcacttcttccatatcaaaaggttttgtaatgtaatcatctgccccaagacgaagcagatcaattttattctgtgtcgtttctttcgctgaaataataagaactggtatcgtaaattgtctgcgtatatctgccagaataatatcgccgcttcgatagggtagcataatatcaagtatgatcagatcaattttttctttgtgtaagaaatccagaacatggagtccatcatattgactgtacacaacatatccgttttctttcaggaaatctgttaacagcgtattgatttccacatcatcttcaattattaatattttatccacttgtgtacctcttttttacaggcaatatccttcttccctgagtttctttccctcttcgatataagaaagtgcactctcttttaaccctgcaatttcttcttccgtcaatacccgcgtgaccttcgccggtctgcccatgaccatgctgccgtccgggatattctggtgttcaagcacaaggcttccggctgcgataagacagttttttccgatcacactgccgttcatcaccgttgcgcccatgccgattaatgtgttgtccccgatcgtgcagccatgaagaattgcattatgccccaccgtcacataatcgcccaccatggtcgggtcgactttggaagtgtggaccgtgcagttatcctgaatgtttgtcccttttccgatgataattttattgtcatccccacgcagtaccgcataaaaaagaatggtactgtcctcaccgatggaaacatcccccatcaccacagattcctttacgatattggttgatgccgctatacttcccgttgtttttgtcatgaccgatttcctcgtttctttccttattttcatactgtttttagtataacatctccgtttttgcttctcaacatactcttttgggaaaagaaaaaagcgaggacatcagcagatgctctcgctcgactccactttacgatttattcgtaaacgtgtttctttttatcttttgctttcgcctgttttttctttaacgggtgttttggattcttatctgacatagtaatcgcctcttttcctcatattcatatgtcaaatttgtttcctttgttatgcctacgttatagcactgtattctggcaatgtcaaccctgtctgttaattattttgtgttttttctgtgaatatgataaatttactcattttatcacaagttgtcaggcattttgtgtttgtgttttttctgtgaacttacaaaatcctccaaaaaaagccattgacattttaaattttcatccctataatggtaaaagttcggttgctaactatttaaaaatcattttaagaaaggagtgatttcttgcaggatttcgatgatgaagaactcaaagaaattcatatgggccgcctgattcaggtactatcccatcagatgaagcggaaaaattgtgtcatctccatgatcaacgatgatggtctgacctccatgcagaaacatgtgttgaaatttcttcttctggaaacccttcacaaggttgtctaccagaaagacatcgaagaagaatttcagatccgcaaatccacggcgaccggaatgctgcagcttctcgaaaaaaatggttttattgtgcgggaaagtgaaaaaaaagatgcccgcctgaaacgcatcattcctacaaaaaaagcggaagcactccgtccgagcatccttgcacacataaggcagtcggaaacacagcttacgacagatatttccgaagctgatgttctgacctgtaaaaaagtgctctgccagatgctctataacgtatcagaacataaggaggtatgtaaaaaaaatgaataagaaacttttacaatccgtccgggaatacaaaaagcaatccatcattgcccctcttctggttacattagaggtactgatggaagtattgattcctctggaaatggcaaaaattattgatattggcattgcaggaggaaatctcggatatattgtccaaagaggacttatccttgtaattatggcaatgatgtccttgtttttcggtgtacaggccggaaactttgcggcaattgccggagccggatatgccaaaaatctgcggcacgatatttattataaagtacaggatttttcctttaaaaatattgaccatttttccacgtccggactcgttacccgtatgaccaccgatattaccaatatccagatggcttacatgatgagtatccgtctgcttgcaagagctccgattatgatcgttttatcctggatcatgacgctgacgctcagcaaaaaagccgcactcttattcttaatcgtcatcccggtgctcggtggaacgctgttatttattgcaaagaaagcccatccacatttcatcaaggtgtttgacgaatacgatgatttgaacaactctgtacaggaaaatgtaaatgcagcccgcgtggtaaaagcattcgtccgtgaggattacgaaattgacaaattccacggtgtttccaaatatgtttaccagttattcacaacagcagaaaaaattgttgcctggaactctccggttatgcagtttgtaatgtatgccgttatcatgatccttgtctacattggtggaaaaggcattgtagccaaaacgatggaaaccggtgccttaacctccattattgtatatgctttacagatcatcggctccctgatgatggtaactttcgttttcgtcatgattatgattgctggcgcatcaacagaccgtatcaccgaggtactcgatgaaattccggaaatgattgatcccgcagacgcagtaacttccgttgccgatggtgatattgtctttgaccatgtcagcttcagttatgccggtgagggtggaaatctttccttaaaagatgtaaatttgcatatcaaatccggtcagacggtgggtatcatcggtggaaccggaagtgccaaatccactctcgtacagctgattccacgtctgtatgatgtcacgaagggaagtgtaatggtcagcggtgtcgatgtacgcaaatacaatctggaagctctgcgtgatcaggtttccatggtgttgcagaaaaacgtcctgttctccggaacaatttacgacaatatccgctggggcaacgaaaacgcctctgacgaagaagtgcaaaatgtatgtaaactggcacaggccgatggttttgtccgggaatttccggatggctacaacacacagattgtccagggtggaaacaatgtttccggtggacagaaacagcgtctttgtattgcccgtgcacttttgaaaaaaccaaagattctgattctggatgattccacaagtgctgtagataccaaaaccgatgctctgatccgtaaggctttccgtgaggaaatcccgaataccacaaagatcatcattgcacagcgtgtttcttctattgaagatgccgaccagatcattgttctggaaaacggtgctatttctggtattggtacatctgaagaattgttaaagaccaatgatatttaccgtgaagtatatgaatctcaggtcaagggaggtgaagatcatgaataacaaaaagccaaagctttccaaaaacaatattgctaccgcaaaacgtctgctgaaatatgtaacagaaacttataaagcacggttcattctcgtgtttatatgtatcttcttaagtgccgtcgcatctattgcggtatcattgtccttaaaatatatgcttgatgatttcatccttccactgatcggacaaaaatcaccaaactataccgaattttaccgtgcacttgccgtcctcggctgtatttttctcgtcggcgtcatcgcaacatttatctatacccgtatgatggtttatatcggccagggcgtattaaaacgcgtgcgtgatgatatgtttgagcacatgcagacacttccgatccgttatttcgatcagaataccaacggttccatcatgagtctgtacaccaacgataccgatacgctgcgccagatgatcagccaggcgattccgcaggcgctgatgtcatttttcacaatcattgttacatttatttccatgctgcttcttagtcctctgctgacactgctcgccattgtcgtaattggaattctggtgtttgtcaccaaaaaaatcggtggaaacagtggaaaatactttgtgcgccagcagatttcccttgccgacgtgaccggatttgtggaagaacatatgaatggccagcgtgtggtaaaagtgttcaaccatgagcagaaatccaaggaagaattcgaccagctcaacgaatcactgtttgacagtgcctcacaggcaaacaaatacgcaaacatgatgggaccggttatcggaaatatcggaaatttacaattcgtgctgactgctgttctcggtggtgttctctcggttgccggtgtgggcggcattacgctcggcgtcatggcttcctacctgcagtttaccaagagttttacccagccgtttatgcaggtggcacagcagttcaactccatcgttatggctctggcaggagctgatagaatctttgccctgatcgacgaaaaaccggagacagacgaaggctatgtaacacttgtcaatgcaaaaagagatgccgatggcaacatcatcgaatgtaaagaacgtaccggcatgtgggcatggaaacatccacattccgcagatggaagtgtatcttacacccctctgaccggcgatgtccgttttgaggatgttacattcggctacaatccgaataaggtcatcttaaaggatatcagtctgttcgccaaaccgggacagaaactggcatttgttggctctaccggtgccggaaagacaacaattaccaacctgatcaaccgtttctacgatattcaggagggaaaaatccgctatgacggcatcaatatcaccaagatcaaaaaagatgatctgcgccgctccctcggtattgtcctgcaggatacccatctgtttaccggaaccatccgcgataatatccgttacggaaatcttgatgcaaccgatgagcagatctacgaagctgccagacttgcgcacgcagaccagttcatccggatgctgccaaacggttatgataccatgttaagcggtgacggcgaagaactttcccagggacagcgccagctgctttccattgcaagagccgccgtggctgatccaccggttctcatcctcgatgaggcaacttccagcatcgatacccgtaccgaaagcattgtacaaaagggtatggataatctgatgaaaggacgtacggtatttgtgatcgctcaccgcctgtctacgatccgaaacagtgatgcaattattgtgcttgatcatggacagatcattgaacgcggagatcatgcggatctgattaagcagaagggaacctattatcagctgtataccggaaaactggaactttcctaaactggaaataccctcctattgcagaaatattacagacttgttacaatgcatttgtacttagctaatacaaatacaaacagggaggtacttaactatgtgctttagatttttttccaactgcgatttctcagcactgatccgtaagtgttttggatgctaataaccagcaaaaaagaagctgcacacgaattttcttttcgtgtgtcagcttctttttgcgtttcctgtctgtattcacctgaccggtccgtctatgcacggaaatcaaatttattttttgatatgttgatttaaaaactccattacttctcgtttctttggaatcgcaggaattccacctctcttttgcacacacagacatgctactgcatttccctgccgtgcacaggcacgcaaatcattccagtccatctcatcaattgctttgttcaaggataaaaactggctcaggaatccaccccagaatgaatctccggctcctgttgtatcaaccgcctctgttgcaaatcccctgatctgttcttttccatccgtagttgccacaagtacgccgtcactgccaagtgtaatggcaatcagctctggtcccatggaaagcaactcctccgcagcttcttcatagctgttttttcccgtcagcaggagactttcttcatccgataccttcatcacatccgcaaatggaatcactgctttcatttcctgtactgcagtctgttcatttctccacaaggatgcacggtaatttggatcataagaaaccaatgctcccgcgtcttttgcgatatgaacggcttctaaagttgcactttttgccggttcatccgtcagggaaagcgatccgaaatgaaaaattttacctttttgcaaaagcgtcggatccagttcttctttccgaagttgtgtatccgcgcccggttttcttgcaaatgaaaatttccgctcaccgttttcatcaatttctacaaacgcaagtgtagtaaaatacttatcatcttcgatcagatggtccactgcaatcccctcattttgtaaggttctttttaaaaatgcaccatgcatgtcttttccgacttttccaataaacgatgtccggtatcccatatggcttgcaaccgtcaacaaattcgccggtgcaccaccgggattctgctcaaacagcttcattccatcttttccgtatcctgcctcggtaaaatcgatcagcagttcacccaatgctacaatatcaacctctttttccattctttaattcctccacaatttcattataacgctttttattcagccgataaaagaataataccacagcagtcacaatccagagaacccccggaatggttgtaaatgcatgtttcataatggaaagtacggctgcattttgtgtctggtttgccacatacccgtattttccgagtaatccggcaagaagtgctgttccaattgccattccaatcttgtttccaagcgagataaacgcatattgaaatccatcgttgcgcaatccggttttccactcaccgtactccacacaatccggaatgattgcataaattgcggtattgaatccggaaaagaaaaactgtgtaattccagacaatgcataaaagataaccggagcttcttttacattaaagaaaaacatggaaagcatcgaaattcctgtcaaaagtgcaaatacactggcagttcttcctttattgttcagtttacggaataccggctgaaagcaggctgctccaataatggaaggaataatgatgcacatcgaataagtggtataatacgaggcatttccttctacataagtaaaataatacaggacatccgcatttcttccatataaagtaaaaccaaataaaatctgtcctaccagagccagcagatacggacgattctgaagcaccgcttttagctggacttttatagaaattttttctttttccggtgtgatcacagcctcttttgtctttgcaaagcaaaagaaatgacatgctgcaaaaatgcatccataaataactgccaccgtcagatatccggtttttgcactgctgcttccaaatttgttaatcaaaggaacggtaatgatatttaacacaccgattgcaatcattgctgcaacggaacgggaagtgttgatttttgcacgctcatcaatgtcctgtgtcattgctccacagagtgttccatatggaatattcacacaggtatatcccaaaacaaggagacaatatgtgattaccatatatacaatttttgcagtctgattccagtctggtcttgcccagaatgtcattacaaggagcaccgccgtaatcggtgccgccaccaaaagccatggacggtatcttccccatcttgtctttgtcttgtcggtcagtcccccgacaatcggatcattaatggcatcccagaatcgggaaaacagcatcagtgcagacactgctgccatactgattccaaatacatcggtataaaaaatcattaaaaaattgctgacaaacatccaactgaaattacatcccacatcaccaaaaccatatgcaattttgctgatcagcggcacttttccacttctgttctcgctacccatacgttcctcctacttcatcagagtttctggcaaaactcgattctctcctcattcggtcctttaatcatgaaaaactttacaccattatcccaaaacggaagctgctcaattccatccgtaatgacttcatatccattttcacagatctttttatacatttcttcaatatctctcacatctagtgcgacatgctgatatgccccgtctgccattaccgcctgtccgttctcaaacgattcgatacagtaattctgaatctgcaaaaacgcaaccttttcttttgccttttcattataggtttctaaaatcacttcaaatccaagacttttataaaattcgattgtcttttttaaatcattcgtcgggagccctatgtgggctactccgacaattccatattcgtttttcatctgtttaatcctcctgcacattgatgatgactttcatcgttgtctcacggttatcatcaatatactggtatgctttcagataatctttaaatgcaaacgtttttgaaattaatggtttcaaatgtacctttccctcattgacaagacggataccatctacataatcgtcatgccggtacatcatggtacttttaatatcgagttcgtgatcatttgcgactgccagatccacctctgccattcctgcaaatactgcaaccagtacgatcacacttccttttcttgcatatttgattgcctgccccatcgtaatgttatttcctgcacagtcatagatcacatctgccttatccggaccaaatgcctctaccatagcctctccaaaatctttgtgcagcgtgttgacacatacatcaattccacattcttttgctttttccaaacgcagatcactgacatcggtaatcataacctttgctgctcccatcccttttgctgtttgtgcaacaagatttccaattggacctgcgccgattactgtgatattcattccttttacatcgcccatctgctttactccatgaactgcaactgcaagaggctcgatcatcgccccttcttcataagacatatcttccggaatcggtgttaccttagatgcatctactgcaaaatattcagaagccgtacctgtggtctggaatcccataacctttaattcctcgcaaagattatattttccatggcgacacggatagcagtgtccgcaataaacctgtggttcaatcgtaactttctgtccgatctgaaacccagaaacatttttccctatttctgtgatttctccggaaacctcatgtccctgtgtcaccggatatttcgtaaacggatgctttccatgatatacatggatatcagaaccacagatacctatatttctgatttttaccagtacctgatcatccttgacttctggaaccggaacctctctaaatgtaatttctcctggatttgtcattacctgctgtaacataattgtttcctcctttatatttgttcttcttttattttatcttttataaaatgttttattaaagtaattacattattgtcccattcctctgttttgtcaatagtttttgagagtttttaccagttgcacaattttttattttactttttgtacaatttttctaaatttttaaacaaaaaagttccctctttaccgcatgtacacgccagtaaagaaggaacttttttcatttcatcattacgaacagcattcttttacatattcatacaaaaaatgttttgccgcaccaaccgccgatgcttctttttcataagaacaatttttcagataagaaatatccctgtcaaatccattgtaagacaataccctctgtcccaatggaatcatatactctgccagtacacctccgacatctcccccaagtataatatccatatcgtatgccatccgaagattggatatcaggatagcaagatgatccagatatctttcccatttttgttcagcttccttatttccctgtttcaattgttccataaatacttccagagaattttttccgtccccagtcagcacacttgccgcacaataagcatctgcacacccctgctttccacaataacatctgtcccctccgggaatcaggatcatatgtccaaactctcctgccttctggttctgtccacgaaacagttttccatcaatgcaaaatgcccctccaagagtatgatttaaggagaggtatatcgcattgttatatttttgtgtatcttccgcaagcatagcggaattagcatcattctcaaaataaaccggaaatcccaatgcctgttccaaaaaacgcagactgtaattttctacctgaagagcatgcgattttagaactgtcttctcattctgatcgataattccgggaattgcaattccaatccctaaaatatctttctccgttttgcattctttcagaaactgttgcacctgcccggcaatttttacactataatcgatatccggtgaaaattttaaacggacacgtttcagatgttcgatttcatatcccagatttacgagtaccatttccagatgattagcggtaattacaagtcccattgccctgcaatattccttgttaattcctatgcttttggcttttcttcctccggtagatgcatactctccattttctacaatcagtccctttgcaatcagctcattgacatttgtcagaactgtaggcatactaagccccagttcttttgccagttctgcctttgatgtaacggaatggttcaacatgtaattaataatttcagttcttgctatattgcgtttttctcttttttccggcataatcttcctcttaaataaagtattttataaaagtatcatatgcttttatttattatttgtaaagaacaaatttcatcctatatccagacaaaaaaccgctgcggctgcaacggttttcattctgtctattattcttattttacggtaacggtctttactttcgaccatgcagaatatgctttcttattgttatcattttctgtcttggcacaggaacgaacccgcacgtaatacttcttttttgaagtaaggtatttgattgtaacagaagtcttctgatcgtgaacacttactttttttgcgccctgaaacttgctgttggttgcatactgtacctcatatctgtaattatttactttcgaccagcttacttttgcactgctctttccggcagaaacagatacggtcggagccttcagatttatttttttcactccgatttcgtacttgtactgttttccataataattatttacatatgcataataagttcctgtataaggcgcaataaacacatcaccggatgccacacagaaatcttttttctttacagatggccagaaagacgataattctgttgttttgccaagcaattttacaatcgttgttttttcactgtaagagtctgcatcacagataaatttatagctctgtccctttttcaatgtaattgcataaaaatcatcattgtctttctcaccggcataagtattttccataaatcctgtatacatggtgtttactttcatatctacagcatcatttttcttctcgttcggctcaagctcacaggcattatttttttcaaacgaaaaacgatacgttgtagaaggccgaaactggtaatgtgattgcagtgatacataataagttccctttgcaagccccacataattatctgctgctgcccctgcacagtccaccatgatcttccagatcttttcccctttggctgtataaacagctacatcataattttccagggatttcggatcctcctcattcaaatgaatccgaaggattccctgctgatccagcgtaaccttgttccagtataccttatccgcatcccattttacggtataatcagtatcaaacgacttctccgttgccgtgtccatggaagtttcctcaaccgtaattccatcggcatatgccggtaccggtgccattacacctgctgccagcgcaagtgtcagtatcatcgcagctaatttctttttcatagtattctcctttttgtttacattttaaccgaaccaattgtcctacacaattcgtccgactctcccattgtaaacatttcaggatgtaaccacaataggcgataagtcctataattaacacagcttgttgccgtttccaagaaattattttgtaaaaattatccctgtgcataccgtgtcaggaactgctttgtccgctcttccttcggatgatcgatcacctggtgcgggtctccctgctccacaatcacaccaccatccatgaaaatcagctgatctgccacatcacgggcaaatgccatctcatgggtaacaatgatcatcgttgttttctgttctgccagtgtgcggatgacttttaaaacctcaccggtcagctccggatcaagcgccgatgtcggctcatcaaaacagagaatatccggttttaaggcaagagcacgcgcaattgccacccgctgctgctgtccgccggacaactgatgcggataatgatccatacgctccgcaagtcccatgcgctctaacaactgtcggccgtgtgcatcaatttcttccaagatctttttcttattctgtttgaaatccggacgttcctgtgccagaagctgttccgcaagcgtcacattctgtaacgctgtatactgtggaaacagattgaatgactgaaacaccatgccaaaatgcagacgttttctgcgcagatccgcatccttttccattccggctgttgatgcatcaaacaaattctctccattaaccgtaatcgttccgccattcgggcgctccagaaaattcagacagcgcagaagcgttgtctttccggagccggacgatccgataattgcaagcgccgtgccttcctccatggagaaactgacatcttttaatacattcgttctgccgaaatgtttttctatatgtgatacctctaagattgccatgttatcctcctacttaaagtaatccagcttacgctcaatataattaaataaaagcgtcaaaataccaataaaaataagataaaatacaccggtgtaaaacagcggccaggtcaggccatcggatttcataaacgcagcaccggcaaaggtcagctcataggctgcaatgatacgcgcaagagaggtatcttttacaagcgtaatgatctcgtttgacatcggtggtacaacgcgcttgatcatctgaagcaatgtgattttgaaaaagatctgatgctttgtcatgccaagcacctgtccggcttccctctgtccggccggaactccctcgattcctccacggaaaatcacagaaaaatagcacgcataattaatcacaaatgccactacggttgcggtaattcgcccgctctcatttccgctccagacggtcgtatggagccagagccccggtccatagaaaataatgatcagctgaagcatcagaggtgttccacggatgatccagaccagaatctgaaccagacgctgcagcggtttaaacttgctgagcaggccaaatgccagcaccagcccaagcggcagcgcaaaaatcagtgtcagtataaaaatttcaaaagtggtggcaagacctgtcaaaagtgactgtgttactgtccagaacatgatttatttcccctctggtacgacaactacctgtgcattgttacaataagcattggtacattccattgcagaagttacctcgctcgtcagagtcattccattccatacgacatcgatattcttggaattcagttccatgaccttgttgtcccagtcgatctctacaaaatcaacctctacaccaagtttttctccgacaagttttgccatatctgcatcaaaaccgatccagttgccatctttatccttataatccatcggctcaaaatcggtcacaccgacaaccaattttcctcttcccttgatgtaatccacgtcactgtcttttggggactgttcaaaggtggcatctttctgctctacaagtgcttcctgaacaccgtaggtttcggcaattttttccatgcttccgtctttataagagtcagcaaacacctgattgatataagaagccagatccgatcctttccggcatccaacgccatactcctcggtcgtaagttcgtctgtatgcttcagattcggataactggtgccctcaccaatcatggcacctgccatcagaaggtcaatgatcgctgcatcagatgtaccggaagcaacttccatcagggcatctgcctgggacgaaacggaattgtactgaaatcccttttcttttgcagcttcttctccggcagatcctgcctctactgcatataccatgctcttttcgctctttccggtatctcctgctcctttggatgcaccacaggcagtcataccaagtgtcagcgctgctgccagcaatactgcaagtttctttttcataatgttcctccattaattattaattcttctgtttactacatgtttaccatattatcatgttatcatgctaaagtaaagaggagtaaattacaaaccttcctgcattttttccctgaccatttttaccatctgaatcaccaatgtcggcacaaatgccagcagcagaatatatccatacatcagcactcccatttctgccacatcaaacagcctctcaaaaaccggaacgcaaagtaccagtcccaaaagaatacatccacccaaaaatgctcccatgctgtacttgttggacccaagtccagcccgtgccatggacttttggctccggcagttaaacccatgaaacaggcgtgccagtgtcagcgttgcaaaagccatcgttgctgcaagcgcggtactctgctgcagccctatataataagaagtcatgaccggacacgcaatcaacgctccctctgccacaattttccccagaaacgaaccggtcagtattccggcagaaggatcccttggtttttcctctaaaagtgctgcatctgccggctccatgccaatcgcaattgccggaagcgaatccgtcagcaaattgataaaaagcagatgcaccggtgcaaacggaaccggaagtcctgcaagtgaagtatacagtaccgccagaatcgctgccatattgccggacagcaaaaacaaaatagcattctttatattccggtatacatttcttccattcaccaccgcctgaatgatggtcgcaaaattatcatctaaaagaatcatgtctgccgcatcttttgccacttctgttcctgtaatccccattgccactccgatatctgcgcgttttaatgccggtgcatcgttgacaccatcccccgtcatggaaacaatccgtccttttttctgccatgcctttacaattcttatcttatgttccggcgaaactctggcatatacacagattttttccagtttttcctgcaattccttctcactcatggcatctaactcccttccagtcacagccagatccccttcctgataaattccaagctgttttgcaatcgcacgcgcggtaattttgtgatcccctgtaatcatgaccgtgcggattcctgctctctttgcatcggcaaccgcctgaatggcttccggtcttggcggatccatcatggcaatcagcccgagaaagatcagattttcttcgctttctatggtcagcggtccttcactctctttatacgcaaatgccagcacacgcagtccctgcccggaaaattccgcaatcttttttttgattttttctgtctccgtcggatcaagtggaacaattccggtacttttccggacaaaatcacagcgttccagcaatacatccggtgcccctttggtcagaatggttccgaccccgtgcaggcaatatcttgtgctcatccgtttccgctcagaatcaaacggaacctcttcgagacgtttcatacagcttcgaagcatttcttcccggtaaccgccttcacccatcattccccctttcggtgcgggaattttacgaaacatttccaacagggcatattcggtcggatctccgattccttttccgttctccaatgtcgcatcattgctaagcaccgcatcgtagaccagatatctgtgcagctgttcttccatggaaagctgtccgggcagatattccctgtcgtccacataaactttctgtacggtcatcttattctgtgtcagcgttccggttttatccgaacagatcaccgatacacacccaaggctctccactgccttcagctttctgacgatggcattttcctttaccatcttttgtgttcccatcgcctgcacaatggtcacgattgaactgagtgcttccggaatggcggctaccgcaagtgcaaccgcaaacatcaatgcatccagaagcggcattttacggtataaacataaccccagtaccactgctgaaattcccataaccagaactgccagctttctgctgaactgatccagactcacctgtaatggtgtcttacgatcccggatatcattcatcatcccggcaatctttccgatctctgtatgcatccctgttcctgtaaccagaacctgtgcgcgtccataagtgaccaggcttccggaatataccatgtttctgcggtctgccagcggcagatcctccggcagactgccttgtgtcttttctacattggtggattctccggtcagcgcactctcattgacctgcagagaataattatccagaatccttccatctgccacaaccatgtcaccagcttccagttccacaagatctccaggaaccagttccctcgaagggatctccttctttttcccttcccgaatgacttttgcacacggtgcagacagatttttcagactgtccagtgatttttccgctttctggtgctgcaccgttcccaaaactgcattcatcaccaggacaaccgcgattacaatcgtactctctgcatttccggaaaacatggaaataagcgcggcgatcagcaaaatgacaatgagtaaatctgcaaactgtgacaaaaacaccctcagaagcccgggtctttttccctcttccagtatattttccccacatgtttcccggatttttttcacctgcatttcggataatccctgctccgtagtagaaaatacgtctcttagctgctctttggaatacttccagtattttttcatggcatgccctccctgtgttgtggtacaaaaaaagaaacgggacttttttgcaccagaataatgcaataaaaagtctcgtttcttcgtgtacagcccggttccagctttcctgtaacgtgatgacggcctgcacaacacccggacacaccggatgcaaactactccctgtttattatctttttgtattttacccatatcctctttcatttgtcaactgctttgtttcttttttcaccacattgcacaaaatatttgtttctttaagcattatatagtataataaatccaaagataaacttacatcagggatttacatgatagaataggagatacgcttatgatgcttacactcattcctttttttgaccggaatatgtccgttagtgcttattctctgtttaccagaaaaaataactttcttatgaacccaagccttcttggttccagacagtttgacggagctgcctatgtagacgggctggaactgattcaggagcttggaaccaccacactctccggaggaaaaccgatttttgtatctttaaataatatctctattttcagcagtctggagtccgagtgcaaaaatacaaaccatgcaccgattctcctgattgaccagacatttcctccggtatccatgtatacagaccgcatccgcgaactgcgcgaattcggatatcattttgcaatgcgtaatcttcctgttcactgctacgaagactacgcaccgattctgtcacaaatggactacattctgattgactgccagaaaatagatgccgtcaaggcttctttctatttccgcaaactgtatccggatatctgtatctgtgccagcaacattccggacatggaaacattcggaaaactcagtcctgcagaaacaatttctttatttgaaggaacctttttccgtatgccggtcacacgcggcgaacataaagtatcgcccctgaagatcaattacatttcccttctgaatctgattgaagaagatgattttgacctgaccaaagcggctgatattatcagtcaggacacggctcttatcatctccctgctgcggctggcaaatacacgctcctttaattccgaaatcacttccgtgcgggttgctgtctcaatgctggggcagaaggatctgacgcgctggattcagacaaccgtcattgagaaactgtgttctgacaaacctaatgaactgatgcgcctttccctgctgcgtgccaagtttgcagaaaatcttgcaccggtctttggcatggcaatgcgttcccaggaactgtttctgaccggtcttttctcgattctggatattattctggattgttccatggaagaagccctctccatggtacgtgtatcgggcaagatccgcgccgcccttctagagcgcaccggttccctggcagaagtgcttcactttattgtaaaatacgaatcggcagaatggcaggaagtttcccgccagctggtgcttaaaaacatcgaaattccggatgtttcccatgcatgggtttcttccctgcaatggtatgcgaaactgattgccatgaatgaataatgtcagataaaaaaaggatgcacaaaacgtgcatcctttcagactgtagacaaagtcctcggctttttgccggggatttttctgtattaaagaggctaaaagtcagtattttcaagacttttcagtctatatccggtgaggagttattttaatttggtaacaaaaaatgccgtatttatgcggtctgtggcgtttcgcaaacgcctaactttttcagatagagagaggggatacagctaaataaaataacccaacagaaatgcaagcatctctgccgggttattattggtttctcgtcgcttacgcacagactactttaatgtaacctttgctccttcagcctcaagtttagccttagcgtcttcagcagatgccttgtcagcctgctccttgattaccttaggtgcgccatcaacagcgtccttagcttccttcagtccaagacctgtaatctcacgaacaaccttgataaccttaaccttgttcggtccaacttctgttaactctacgtcgaactcagtcttctcttcagctgctgctgcgtctccgcctgctgctgctactacaacgcctgctgctgcagatacgccgaactcttcttcacatgcctttacaaggtcatttaactctaatacgcttaactctttgatagcatcgataaactctgctgttgttaactttgccatgattatttcctccgttataattttatttttaataattattctgctgctggtgcttcctcagccggtgctgcgtctgctgctgcatctgctgcgccacccttctctgcgatctgattaagaacgcgagcaagatttgtgataggtgactgtaagcttccaagtaatttggaaagaagtacttctctgcttggtacacttgcgatctgcttcattccctctgcgtcatagtatgttccttctacaacgccggccttgatctcaaggcttggagccttctttgcgaactctgccagaactctggctggagctgtagcatcttctgtagatactgcaaatgcgttaggtccttccaggacatcctttaagctctcgaactctgttccctcgattgcgcggtttactaaagtatttttgtatactttgtaagttacgccagcttctcttaaatttttacgaagctgtgtatcctcagcaactgtaagtccacggtagtcaactactacaagtgactgtgcgtccttaattgtttcagaaatctcctgaacgatcggctgctttaattctacctttgccacgattcatttacctccttattttatttcttgcatatagcgtgaggtataataaaaaccctccgccttacagcagaggggtatcattctttatgacgattatcatcaaaaattccctcggtaggtggatttccctttacgctgtcgcaatatgcgatagcaccttactgtcttcggcaatatgctttgctattataatatgttcttatgcggatgtcaagtgttttccgcattttgcttgtgtaagtctgatcatacattttatcatttcatcaggaaccgtttccggttcccgacttctgatttttttattactgagcaatctttacaacgttaagctttacgccaggtcccattgtagaagttaatacagcactcttaatgtactgaccctttaagcttgaaggcttagccttgttgattgcgcccataagagactggaagttgtcgttcaactgctcacttgtaaatgaagcttttccaactggcacgtggataatatttgtcttgtccaaacgatactcaatcttaccggctttgatgtcattaacagctttggtaacatccatggtaactgtaccagcttttgggtttggcattaagcccttcggtccaaggacacgtcccagacgtcctacaacacccatcatatccggtgtagcaactacaacatcgaagtctaaccatccctcgttctggatcttcggaattaattcctctcctccaacgaagtcagctcctgctgcctgtgcctcgtctaccttggttccctttgcgaaaaccaataccttaacggtcttacctgttccgtgtggcagtacaaccgcaccacggatctgctgctctgcgtgacgtccatcacagcccgttctaagatgaagttcgattgtctcatcaaatttcgctgtggcattcttctttacgaggtcgattgcttcagcaacatcgtactgagcacttctatcgtatgcctttacagcgtcctgatatttctttcctcttttcatgaaatataaacctcctggtggtaatatcgggtgggaaatcaattaccctcccacatttcttcttaaacttagattagtctactacttcaacacccatagatcttgctgtaccagcgatcatgctcatggcagcttcgatatttgcagcgtttaagtcaggcatcttcagctcagcgatttcctgaacctgtgcctttgtaatctttgcaacctttgtcttgtttggttcaccggaaccagacttgatcttgcaggctttcttgatcagtactggtgcaggaggagttttagtaataaagctaaagcttctgtctgcatatactgtaataactacagggataattaagtcgccctgatcggctgtctttgcattaaactgctttgtaaactcaacgatgtttacaccgtgctgtccaagtgccggtccgactggaggagcaggtgttgcctttccagcaggaatctgcagcttaatgtatccttcaactttctttgccattggaattgcctccttaattcatcttctttacatctgcgaaacttacttctaccggtgtttcgcgaccgaacagatccacattgatcgtaaccgtctgtttgttatggttcatcgctgtaatcacaccgcaggtatctttccagacaccgccgataacaacgatcatgtcgccttccgcgaaatccaccacaacgttttcagctttgattccgagcggtctcatttcagcatctgtgagtggcaccggtttgcttcccggtccaacgaaccctgtcacaccgcgggtattgcggacaacataccatgtatcgtcattcataatcatatgaatcagcacatagcccgggaacattttcttggaaacctgttttttcactccgtttttaacttccgtcacttcctcaagaggaacacggacctccaaaatctggtcttccagatgtctgttctcaattgtcttgtcaatattcgctttgactttgttctcataacctgaataggtatgaactacataccagttcgcctctgccataaatcactatgcctccgttaaaatttcaaaccaacaaggaaattcacaccgtgctgaattgcccaatccagcagtgcaataataagaccgactacaacggatgtaacaatcactgcaatggtctgtctgacaactgatttctgttccggccagatgatttttttgaactctgcctttacaccgtcaaaccagcttgtctttggagccttttcaacgttttctgtctgtcccatttcataactcctttgctctgtacggactatttggtttccttatgaactgtatgagtcttgcagaatctacagtacttcttggtttccattctgtccggatgagtcttcttgtcctttgtcatgttgtaattacgacgctgacattctgtgcaggctaatgtaatctttgtacgcacaacttccacctccgttattaattttcgtgttttgtcccgcctaaaaaaaggcataaaaaaaagacctacttccaagctttcatactatatcatgattttccatgtccgtcaacatcttttacaatggtttttatgattttttgcagcttttacgccaaattgtgaatttttagtaaaattttaccatatacagaggtagggaaaatgcggtatgatgccgatatacaattcaagtagaatctttttgggtgcaaaggatatgcacctcacaggagaacaggtcttttgctgtcctgctctcaatcctcaattcacggaagaaaggaggggaatctcaatggcaaagattgataatgcctacgcttattatatctcgacgtatgcccagaaaacggtttcacgttatgattcacacaagaaaagtgaactgcgcaaagtttataataaaattgtcaaaataaataaagattcgcctctttataaaattccgaatctcaccgatgcgaaaaaatatgccatagacatcaaggaaaacgcgcgctccattcagaacgttgtggcatctctttccgaccagtacggttcatttgaggattcttttaagaagaaagttgccatgtcttccgatgacgaaaaagtcagtgtgacctatatcggcgacggaagtgaagaaagtaaaaccaataactttgacattgaagtgcagcggcttgccacaccccagatcaatcagggacgttttttaaaagacaatacactgtcgatgcgtcccggcgcatattcttttgatctgaatacgtctggtgctgcatatgaatttcaatataatatcaattccgacgaaaccaatctggatgtgctggacaagctggccaggcttgtcaactcctctagtctcggaattaccgccgaaatactgtccgatggaaacggttcgagtgcgctgaaactgacttccatacagaccggtctggcagataacgaaaccgaacttttttccattgcaccggatgccagcacaggttccacggaaatcatggatcagctgggaattgaccgcatcacttcccctgcacagagttccgcctttacactgaatggcacaagccactcttccctgaccaacacattttccatcaatcaggtatttgaactgaccttacatcagccaaccgatggtgagaaagtaaacattggatttaaaacagatgcggatgcaattgcggacaatatccagtctctggtggatgcctataattccatactttccaccgcagccgtgtatgcagacaccaatgccagtgccggaaacaaacttcagacagagattctttccatatccggttcaagccggagttctttacaggacatcggtctggtcacaaacgagaacggctccatctctattgataaagaagcgctccgtgaagcagttgttccggaacgtgatcagaatacctttgaaactttatcccaatttcgggattccatcggaaaagaagcggaaaatatctccatcaatccgatgaactatgtcaacaagatagtcgtggcctataaaaatcccggtcacaactttgcaaccccatacatcacatccatctattccggaatgatgctggacaaatatgtataacaaaaagagcattccagctgtaaccatacagcgaatgctcttttttgtatctttctagaagcctatcccaattctttttcgcacatttccagtgcagaagcgatcacagcgtccatatcatagtacttatactctccgagtcttcccccgaaaattacatttttttccttttccgcaagttctttatatttctgataaagagctccgttctttccatcgtttaccggatagtacggttcatcccccggtttccactccgaactgtactccctcgaaattacagtcttcggtaaatcatgtccctcatcatccttgccgaattcaaaccatttgtgttcaatgatacgtgtccacggcgtctgggcatccgtataattgactgctgcatttccctggaaattcggagtatccagaagttctgtttcaaaccgcacggaacgatattccaacgcgccgagcgaataatcaaaatacgcatctatcgctcccgtatataccgttttctcagccagagccttcagttcctctttctgctccagataatcaatcccaagccggacttcgattccctccagcagatgctcaaccatctttgtgtaaccgcccatcggaattccctgatacagcgcattaaaataattgttatcaaacgtcaggcgcaccggaaggcgcttgataataaaagcaggcagatccgtacacttacgcccccactgtttctgtgtatatcctttgatcagtttctcgtaaatatcggttcccacaagactgatcgcctgttcctcgagatttttcggttctgtaatgcctgcggcttttttctgctcctcaattttcgcagctgcttcctccggtgtcaccacaccccacatcttattaaaggtgtacatattaaacggaagcgagtatagttcccctttgtaatttgctaccggtgaattcgtaaagcggttaaattccgcaaattttgtaatgtaatcccacacctttttattgttggtatggaaaatatgtgcaccatacttgtgcacatggattccctcaatgtcctccgtataaacatttccggcaatattcggacgtttatcgacaaccagaacccttttcccccttgttgctgcctcgtgagcaaatacggagccatataatcccgctcctaccaccagataatcatacttcatttctttctcctttgttttattatcagttcaatcagccataataaaatgcaaccacataaaacacctatggtgttggtcagcatatcatctacttcacaatacccgcgtttcgtcacgtactggctcagttccgtcagaaccgaacagacacctccgagtacaacacatttccacatcggccgcagctggcgaaaacaaagcggtgccagaattccgaaaggcactgtcataagaatattttcaataaaaaatgcatgggtaaccacgctgtatccccacgtggaaaacagatccagattcatgcacccgtttctggaaccgggttctctggaaaaaaaagtaatctgtatcaccacaagtatataaatcgcaaaaagtatacgaaaaaaccggacggatgctttttttccatcctttttttcaaaaagtacaattgttacaaccagcccaagtaccacaataaccagtgcccatggcacatattgaagtggctgccgcatatctgccaaaatttgttttataatttcacaccacataaattttattatagccatggttcaaaaaagatacaagtatatttctttatttctatgtaaaactgttgcaggatagtgtaatataaaagaaaaacgtcggaaggaccatctgttattatgatcacaataagtttatgtatgattgtcaaaaatgaagaaccggttctggcaagatgcctggattccgttgcttccatgatggacgaaatcatcatcgttgataccggctccacagatcgcaccaaagaaatcgccgcacaatacaccagccggatctatgattttacctggtgtgatgatttctccgccgcaagaaattatgcgttttcgcttgcaaccatggattacatctactgtccggatgcggacgaataccttgatctggaaaatcaaagacgttttctccggttaaaaggtgctcttcttccggaaattgaaattgttcagatgaactatatcactccaccggatttcaacaccgtgcagaactgcaagaaagaaccacgaccaaaactttttaaacgcctgcgcacgttttcatgggttgatccggttcacgaaacgatccgcaccgatcccgtcatctatgacagtgatattgatattctgcaccgcccacatgccatgcatgccaaacgggattttgccatgtttgaaaaagcatttcgtgaaaatcgtgtcctctcggaaaaaatcacgcgcatgtatgcaagagaactttataaatgtggggatgaggaagattttctgcgcgccgcagattatttttcgatacactatgaagcacacgctgatgcagaatccgcgtgtattctggcgcacgctgcccgtatccaaaattctgtggatgatttcttttcgatctgtctgaaagatatgtgcagttcttcctgctccgaaatctgttatgagatcggacaatactaccgggaacggcagaatccccaagaagcttctctgtggttttataatgctgcatttgagacacagcctgttctggatattgaaatttcaggaaaaaaagcattgctgcgactggcggaatgttaccgcacgctggcagaaaatgacctctgtgatccatgctctgccggggatcttctctcccgtgcttcggaatatgaacaacaggcacaggtgtgggaactgccggaagaattataatttgcgaaagaatcatttataaaaaaaatgccggtgcagctgcaccggcaaaaatctttaattagttcaaattaatccaatgcttgtcaacccaatatcctctggtctgattccaacgacgatactgaactttcccattataagcacgaaatttagtaacaatctcatccgcacacggtgcaacaccaatatcgttctgaacactctgctcctgcacatcctgctctacttccgctgcactcacattcacagtagggcccacaacaaataacgatgcacataccgctgctacaattaaaagtttctttttcatatcatttttctcctttctgaaattcaaatccgcttttttccataagatccacagcttcactatctaattggaaattttcatttccgctatgaagataatacttccccgctttttcatataaatatgcatttttctgttttatctcccaacattgaccattttgcacatcataaattccctctggcacatcatacctcggctgaaggataagtgaatacgaaagcaccaacagtgcaaccgcaatcaccggaacaaaaattcttccaatacgcgaactactttgttttccctccgcgaccagacgaaatcgttcgatcagatgatccgaatgatcttcaaacaacggcatggctcctgcaggttttcgaaattcttttccctgcacacttgccttatactcttttaatatcaccgtcagatagttaccccgctctgccgatttaagtttctttgtaaccgtctggtcacaacggatctcaatactctgatacatatctccttttaaaatatacacaaacgggttccaccagaacacgatacacagaatgttgatcagctgtatcgtcagtatatccttattatccaaatgtgtatattcatgtagaataatataatgcaattcttcacgcgaatattttttgtccggaatcaatatccgtttctcaaaaatcccaatacaacacggtacttctaccgctgctgtctgtacgatcttaacgttccgcttttctttatccgtacaaatttcatctaaaatattatttaattctgtatcttccgttttttccatctctgaaaaatacgacacaactctgtgatactgtatcagataccgcgtcaaaagaactgccatgaccactccccatgccaccacaaatatatgatagacatagatttcgtgccttgccacacaggttatttcacacccgaatatctgatacaggaaattatacaggctgcctccggataccactttcgtccatggcaattctaccgggacgacaagcctgatcagacaaaacaaatataaaatgatgattcctgtcatactggataaattcagcagaaccgatcgttttctgagaatgtagcacagtacaataaaaatgctacaccaaacgaacgtcatccaaaccgaaaatatcgttatttgcattcttattcctcatcatttttcagggtatcaataatctcctctaactttgcaataacctctgcatttttttcttttgcctgcttatcttttgctccgatcagagcagctgtaatgttcgcaatagaactgctgtcaattccacgcttaatcaatacagatgcataataatcgtcttttgacatagacggagcgagtttacgtgcataagtcttgacggttttctcaagtcctacaacttccagatagccatccgttgtcagagactgaacggtcttaaacaatgtaacattgttccatccgtcttctgccaggcgctctgccatctcgttggcagtcagcggctcattgaccttccacagaaaattcattaattcttcctgtcttactgttaaataatctttgttcttcatgtttcttcctccgtagttttataattttatatgtagcaactatcattctctgacattacatatatcaccaactctgccttatgtgtcttttctacactagacagcctactttatcctatcatatttgaattataatttcaattgcttctgacaagaaatatgccattttagataaaaaaagaatagccgttttcgcaaacagccattctctcttctcagaaacatttatttttgataggtgtatgttccaaccgaatacttaccgtgcagatgtagcgtctttcggaacctttgccgtatatactattttatttgtatccgcagtaactgttgttgtcatctttgaaaatgtggtatctttatctgcattccttcggtatggtaaatgttgcagccttattaaaatttttataggttaccgttacttttgcctgcgaataaacaagtttcagatcctgtcccagcttctgatacagcgccgacatatacccgttcataaacgctttcatatccgccgtggttctgactggacggcaggtttttttatcgatccaacaggtcactttgattgccggcaacgtattgtaatccacagcagctgccgcattgatctctttgctcattcccatctggtccaaaaatttcaccacatcggagccctttacctgcgccgaaatctgaacggtattgatccggttgacttttattttctttttcacaatttttgcatccgaatacatggaaatatccatacctttgatctgattggtatagtttaaaatccctgttttctgatatccggaaccattggaagaaatgtactcccacagcaatccatccgcatcttttgtcagataggcaaccgcctggttcttagaactcattcctgcaagtactgtggttgtatctgttacgctttttaccttcagaggactgttgtatacgctttgctttaccaccgtcttattttgaatgatctgcccttccattgtcatcttctgatcggttgtctgcgtaaaatcatatgattttaagtttcgcaccgctatatccatcttttccaaatactgctgtgcagacagcgatgccgcacttacaggtgtaacagctgcaaatgtgctgagtatgacagacagtaccaaaatgaccgcaatttgttgtttttttaatgctttcatcgttttcgttctcctttctttatgtgtcgggcttagacgctggttttatctcattctcttttcctataccatgcacctgtcaaaattaatattactgtccagtaaaaactttgataatattttcatcgctctggcataaagatactgtttgtttaattttttcttgtgatattccagttctgtccccttcgtatgttcttccagtacatgcgtaaaatacctttcccagctcaggtattttgtgctctctgtatagtcacttggatttttcaggatacgataaatcattggatcttttgaaaacataactttcagcaacagccattcaaaagattccggagcatacagatagcagttaaaatgatcttcgatgtacctgaccgtagctcccatctccggtccatatgccgctccatctacaattatgagatacgtcttattttcctcaaaatcaagtaccttttctggaatgttggattttccatgtgcgctatgacattctgctgaaactttttcagctaaagcatgaaacatctccaaccctgaattagaatcctcacacagcacgtaatccggcgtaataagccggggcggataacttaatgtcgaactatatacattctgaagttcattgacagttatctcatactcattatttaacgtagcatattttcctgatacatgcatactatatacttctttaatactgtatgccagcattggaagatatgcgcgtgtaatcaaaacaaaataattatccgctgaattaacaatagacgcaaatttttcgctcctcattgaactgaaattttcatctacaaaaataatggatttcggatgtctttcaataacatcctcccagtcaaaatctgtcaatgcataacaaccacagtcacaattccatgcaatcccactgtttttcttctggttcatttcctgtataagattatataaagtagtctttcctgttccgctgtctccacgtataatggtaatattgcgtgataatacaaagtcatatctgatcgtattatctccaatttgaactctgtgttttcctatcatatgatctgatcacctcacaaaatgaatagaattacgatacaactctttggaatcgtgacaaacagccccggtattttgtatcttaagttcaaacggttccggaaaatccatgaaataattcaaattgatcaaagtgtcctgtttttccgcaattttaagaagccattcggcacaattttccccacatgcagtacaatctatcaacaactccggctttttataaacaaggataagtgcctttaccccaccagacaatttcgatgtcggaataattccaagaacaggactttcaattgcatgggatgacaatacctccgacttgtctaccgcccggatcatctccttaacaaaagggtcctcaaaccatttttgagaataggtatgattaaaataggtgtctgggtcattgattgccccatcaacctctccataaacaattgttaacataattatctcctgatttatcctatacgatttcacgaatgaaatgttattggttttattgattaataaaaatccattatactttgcatatagtataacggattaatattaaaaatacaattttgttttaaacagtgatacgaatccctgccctgaaaacaatcttctatttgtcgaggctctcatatatgtgaacttcctgtgcatatctactgcctcacacacaagctttctcctaccttttgtctccttgaaatgcttcactccatctgccaataccttattttctctctttcccgcttcgctttgatgagaatgatctgcagcacgtattctgttgcttcgatattcttatcaaaacatatttctgttttcgcatgcagcttctataaccgaaacgccttcgcataggcaagatgaaacgcatattttccacccttttttacttccggctgtatattggcataattacgttctttgtatgaccagaacatcttatttttctttctgccatttggaagcgtttctaccgttttataacaaataatattagtatcatataataactgcagagcttcacttgcagtttccataaacggaggaatcttgcgctccaacgccttcaaatatcgtacgtactctaaatgttttgtttcaaaaaaagcataatcaaagtttttatgtccctgaaaataatcaaagaataaaataaaattactgtaatcactgtcttccatataaattaacatataatccttcaattcgccttttaaatatacggaataatttgtcagcatatcttcaaaatccgcatgcttaaatgtatttccattgcatgcatccaccatttcattcaacatggtgagtatgtctcttggtttgtacagcgaataccttaaaaattctataaaaggattatccggctgcttccatggtgcttgtatcttatacggaaaataatgattccaactttgtcccaataaatactgctgatcctgctgtttcataaaataatcatccgcaatcttaaacagtttggaatcaacatacttacgatatgttgtcacccaattcaataaaacagcattattccgaagtttctgattcatattatgaactggcattttatacataatatcaggtctgatcaacaacataaccttaatatttttttctttcaggaaagattgattcatttccaacacagcattcaccaatcccaccagacaatcaaaatactgtgcattatcgatttctcttggtcttgcatcaataccatcaacaaataatattgttgaacgcttaagttttatattttgaaaagctttctcaaaaccatcccttattttcataagactgatctgataactttgctccacatacttttgcgttttttctgcttttgcagtacttccagaactaaacacaccctgatccatcattgtattgattgatgcagacgcattatccacaaattcaaatgcattaataaattccggcttaaaagcatcacagtaaaaagaggaaatcgcttttgacaactgtttatattttaaattgctaaaaagagtatcaccatactctttgcgaatattttctgccaaaatcagataaataagattgatccatatgtctttatatcctgacaattcaagtgctctttgattcttcatattcaaaaatctttgatataatgtattttcaactaaagatatcgcacagaaactctctatatttgcagattttgacatatatacagaatatgctgttttaccagatcccttctctccgaccaaaaaatatttatctggtttgcaaatttcgtctataatatcatctacaagaaatattttttcaaacaaatcaacttcttcaccgccggcaatatagtaatcatacgcatcgcctttgatctgctgtaactcctcaatttttttcacgttttcacagcctcccacgttcatgacatttaagctaataatttattataccacatttccagtaagatacgatactatcttttgataattttatccgtaatctgctgttcaatcctgtcatcgatacttatttttctacgtgccattactatgcctccttcgtattgcaggatctgagatcttcattaatgtcagcagcctgcttcctgacgtttatctcggctaagccgaatgctttcagaatcgacttctgcgttgcggttactgcgtaatcccgatagtattcgccatcggtttgccgcacaatttcgattttctcaagttcacggacagccgcaggcactgtcattatccgcatggcaaaggagttaaaggccactcttgtcagccttggagtttaacattattttataattctttttctgtattttaactcattttaagttataatacagaattcaagttaagatttgctacgaatcactttttctttaccatgcaacgttttttaaagaacgaaataccgtagcaaagaatctgatcgtaatcatcctcatactcctttgcatacatccgatcatccatttgctgcaaggctatatcgcattcactttccagattttccaaaactttcgtgtactttgcttcaaagattgcaacgcgggcattgatggaatcgtaaacgaccacatcacttcggccttctccatgctccttattggaatccaccatatatccggcacctgtgaagatgcccgcaaggaaagcatgatagaagtcttcccggtagtcatggtagcttatggtgcgccggagcagagcattcatttccttggtaatgccttcgctgtcaccattccagactgcatcaaacaaagcatttcgattccacttcttcgtactgtcatcgaaccatttgatgactgttgtttcaaaaatctctttgatttctgcattcggaatcataagggcaaccatgccatccggcaactcacccttataatcttcttcacgcgccttggttaagtaccctgtcaggtacagcgtactccaaagattgtcttctgaggaatgtagataatcataggtcaggttttcatccacacgctgaacgatgcagccaccagccatcagggtttcaagtttatttgtgatggtactccccgcatagtcaataaaggaacggatgattgcattgtcgctggtgttcttccagtaactgataggcttagctttcggattgcgctgcagttccagcaaataattcattacatcccacgggcagtaaacatcaaaggctccgaaatggtatccatcataccatttcttgatgctctcagcctgcgttgtcaagtcagcatcctttagcagcaggtcaacctcactctgtacaaatccgaaatactcgttcagacgagaatttgtgatcgtatccgatacaaaattatttgttcccgtaaaaatgctttctttcgcaatctttaagcagcccgtaacaactgcaaactgaagtgcttgattgtcttttagggcctgcatcaagcctttcataacatcgaccatttcattataataaccgttgttattcgcttttgctacagggacatcatactcgtctataagaagaattacaggctttgcataatagctctgcatcatcgttgtcaaaagcataaggctgctcttaacttcttttatagaaccattgccatgtgcaagatgctcaaacgctgttttttggaattctgtagcacttttactatcaagcaaataaagatgtttgttgtacaaatccgctatcaccattgtgagcatatcgtatgccccagtgaaatccagaccgtctacctgtcggaatgaaataaagactgtaggatactgattcatccactcatcacataatgcctgatgctccgcaatttccagtccctcaaacaattctttgctgtttttacggatgtcgaagaaactttccagcatactcatgccaagcgtcttgccgaaacgccgtggtcgagtgataagtgtcacttctgctttttcgtccaaaatttccgtaatcaggccagatttgtcaatataataaaacccaccgttccgaatcttctcaaagtccgaaataccaactgggatgttcaattttttcatctctgctgctcctttcgcgtagccacacacagactttttattgcttctatgataccatgaatctcatcatatagtgccttctgtccggcaataatatccgcatccgtcttacggacagaatccaattcaaataaatatacatactttcgcatcgatcaaccctttgtgtaaaaagtcattgtttcccgcagacaaggctcttcataatactttctgacccgctcctgaagtttgacaaatagcggatagaactccaccgtaatccgctcaaaatatttctttgctaattcgccatcataatcatgagccagttgattccgtgcccgcagcatttccagccacatatcactttcaatgattccattggagaaagccgtctgtagcacttccctcggtgaacctacagcaaaatccaggattcccatatacttaactaaaatatctttcataatcttccaggataaatcaaaggtaagattataattctgtactgtaccttctaacacaaaatctgcctgaggatccgccacggtgcttttcttcagattcgctaaactatgacaaaaagaatgatatcgattaataaatttgttttccatacttcttaatatcctccagcaaatacttattttctatttcatcataataaaagaaatcaatcttcctaagtgtatcaattttctccacagcttcttctaacgcctcatgatccacttctccgtaaacaacaaaatcaacatcgctacgacttgttgcggttccagtcgcaaaagatccaaataaatccaggcgtactacatgaaggctacgacaaatctgtgtaacacgcttaataatttcacttatcttcatcatattgaaatcaaattcctggaccatatacactctctccaaacataaaatccgctatactgtttatagtatagcggattcattttaaaaatacaatttagactcgcacatatctgtgatttctgctattcggcttatccctcatattcaaaaaattcttgacttttcacccgtcatttgctattctgatttattttcgctttttggcacagaagaggatcggcactatggaattgaccgttgggcaaaacttttcaaaacaaagacatgggaggatttgcgtatgatcacaaaaaataatgaaacaattcaaaaagctgcggactccttatatcagctcaactcagacgcagtagcccgccagtgcgcgcagtcacgcgctaatgccaccccatgtcttcacctgaagccccatgcggcttattcgtacttattttaattattagacaactcactgattattgtatagcatataattctcctatttcctgaagaatctgttctttcgttcgtcccacaagccccaactgtttaacatcaaccgtttcatttttcattcgatcaacaaacttctgcatatcctcatacacgccactgggagtggcaatcttgactgtagggtcaatcagttcagtcaatcgaaaaacatcatttttatgcttcttaatgtttttactatcaacgtgttctccggcttctttgcgatccgtcaaatccatccatgctttcgccttgaatggaatcaaatatgcagcatccaaaaccgtcactccatcaacagtcactttcccctgcttcaagaactcatagtaatcatcatccaaaaggattgcagacaagctcgatatgtcctcatccattggcagcggtgtcaatactgcatcatctggaagttgaattgcatccagttttctagtgaacagttcgatcattgctggataacggtttgaggtcgggtgactgaagcgataaaactgcggcacaccagagcttttattacaatgttcatatccagcctgttttacatagtcccagaattttcttccaaaagccacatccacggcttcaataattagaacaagatcaatgtcttttgttgcacggaagtctaagccttcttccgtcatcaagatgtcacacgcagttccaccgataattgcatactggctttcgttacccttgaaccattccttaaagctttcaatccctgttaccatctatcttcctccacagatcatttaacatttcttctactgcttcttctacccgttcatctgcatcttccctgagcgataatgccagagaaagttcatcgaccatttttttcttcgataattttcgtgggtcatatctccacatttcaacagccacctgtgaatttgagtcctgtaaatcctttgtcatacagtcattccactgagatattctttctgaagcgtagcaccaaacaccaggcgcattgagcatcgaatactccgccaatgcggaatatccgctctccaacaattcattctttacttcctcgcatggaacgtagacagtccttttcacaggattgagcagaactttctctgctttataaaacaactctttgggggagttttctgaaaacagtatcttctgtactccgatttttctcgattgcagcgttcccatttcttcaagttgtttggacgccctggaaatagatgttggtgtcaaatccaaatcttttgcagcttgacttgtggacagttcctttgctccctcataaataaaataaagcaacagcatctgagctgatggcaagatttcttctctgtcgctcttttctgcatcacaacgttcctgcaaatatgccgccataaagggcagataaatttgctttccatccacaataaatgctatcttttctcgaagtaaatactctttctgccgtgcagtgatttgttccagtactaaaaccacagggctatctgcaacctttttcacacgttccagatgcttttttaatgtttccacctgttccaattcggttttagggtacaaaaaaacggctttttgaccactcagagatactttctgtgaatcgtaccttgtactgatgaagtttggcaaatgctctaaagctttattttcatacagcacttcaattcctaaaacccgcttaaggtattccactctatcgcctccatttataactctttttctgtattataacttactttaagttaagatacaatatcaaggttatgattggtcaaccttttatgttttttagccagaaaaagcagaaatttcagttaagatcacttaaattcgcacttatattccatatatttcttaactctttttaagtctactttatcgtccagatagtctttaggtcttatggaaataattaatttttgtactattttatcatgagaattcacaaagcgatcaatcatatcctctatcacattttctaatgttgcttcacgaattgcagcctttccagtcccaataagaggcatagcaaggttatcacaatgtccaaacttatttataaattccaacactccattcaacgcagtatcaacattggtatagtcctgattttccggttttccaaatttatttacatcattaatagctaaaaagtaataatgctttcctctgtaatcaactttagctacagttcctattggatacttctttgtttgaccatgtatgtctgaactatcttcaccctcaattccctgttgcataagactttcagcaattaagttatccaattcacctatattatttttgaaatatctaagttgaaatgccccctgcacactttccagactaatatagtcgccctccatcactgttcggaaaaatgtattggtaggtataacataactggacgctttaatagaaaacaaatcactcactttaacttcaatctgcaaatcagcatcttccattgttcctttgcaagatattttttcatgattgtgaataaaagaaacaacaatgccaatcagcactaatcctaaccaatagtttttgcacaatatttcagctttatcaaaacctgctaaatctttcagaagcactgcaaatgtaaaaatcgatgagatatatcctatggctgtatacaacaacttccatactgcatccagagaatttttctcggtgccaaaactttttaataacacttttattctatcccacacatccctattcatatccaagtgcatcctttatgtactgataatctccaactctttttccccatgaattctttatccaaaatggatgcgcatctttttcataggcactcatatagtctggaagccagccagactgtttgttaaatgagttatatacaataataattgtcctttttttcttttctgcctgtctaaactcatgttcaagataagagcatgtattgatcttaccataattttcatcaggtcctggagtatatgtctttccatagattttacatataccagctccatttgaattttgcttatatggcgtacatgcacacccttctccttcactgtttctcttacaataacttcctgctgtccgaaaagccgttttatctcctatgataaatataactgccgaagagacattaatctgtctattaaattcttccttcaaatcacatggacgacagtcctcatcttcagatacgcttccagaaactacctgagctgtatctacataatccactttatgtttgttatcacgtccccatctatgaagctcttccacaacatcccgatcaccatcattttcagaataatctgcactaatataaacccgtttactcaaaacttgtcttctccttccacttgaataatttcttattcaaaataatattcatacatttttccattttcaaaattattcttatcccaatagtctaatgtaatttcgtcttggaataaaattgctttcaaaacttttaaagtttgattatgagcacataccaaaacattcttctctgcttttgcaagtctatccagataaaatgaatatactcgttcataaaattcactaaacacttcgccttcaggaaccgttttaaatacattaagctttcccttaataaaatattcagggaatttctgttgcatttcaaactgtttattcccttcgaaaatacccatgcaacgttctgttaatcttgaatcataaactacagaatccaacaacttcggacacaatttttctaatgtctgtctacatctttttagtggtgatgaatagattactccggtaaagtcgtcaataaattctagtgccgtatcctgtagaattgctatatccgcctgtcctgaaatacgttttgtttcattatactctgttttaacatgccttatcaatataactctatgcttccctgtcatttaccttccctttctttgtattgcaatacagatacaaaggcctaagcgtctttacaatttctcccttcaacattttctttcctctttcaaaaaattctgccccatcctgaaaatcccgaatatgtttaccttcagttattcttgacttggaatgtactttatatatttctctatcaattttcaactgtttctttttaaagtcagaattaatagatcgaacattatctatcacctgaccccatccatgtggcaccaaacacctttcttctccattgattctgattttccaattttcatcagatactttaaacagataaatatcttttccaacggatgaaaaaattggaagtattgttccaggtttttccacaaaagttcctatcgcaatagtagaatcatttggcatataataatgatgaaacgtatttttctttataaaagcatctccttgtattccaatctgctctgcataccatttatgaatctgcacattatattgttccaatttatgagcataagcggcaaattgtcttgcatcttcatccttaatgtatcttaaatatcttccattatcatgatatgtgcgtatcgaatcactaaaccagttttcttctaccggatataatcccatataagaatccttaaattctttcactgaagaatgcataacaacatacaaagctttatcatccaggctctgtgcaatcattataaaatgatttccattgtcaaaactaaatgaatatcccttctcttttgtcgctttcataacaatactatcaatatatttttcaaattcctgatcactcatttccggaaagttattaattcggtatacactgctggaacatacattcacagttgcatcaactggtattatggctgttccacatttccatgtaacaagcattcctgttgcaaagccgcccgccaaacgctgaacattatttggaaagcctaaatccagagacggataaatcataataccactacttggcacttcaacaccatcaatctcaagtgtacttgaatcatactttttgagcaccccttcaaataattcttttgtacgttttatatatttaagtaatactgtctgagttgcatcacctaacaaattctttgccttaaacaattctccatattctcttatatcatcagatggaataaatgccgcattaatacgtggttcctttgtccaatcttctgtcacataatttacaatttgagaatgatacaatttatgtagcttcacacgatcatactttaattctttaattcttttcctccaatgttgatgactttcctgtgcctttgtttttacctgttgcggttttaatgtatctatttcaaaatctattctggtacttgtactcatcaacttttccaaatatctgcggtgtgcatcgtattctgaatttttcacatgaatatttcgatacactgaaaaatctcctttaaatcttccatctacagtccataattttgtacttctgtaacccatatattcttcactgattacagcatgatcaatttcaagcaatggtacaaaataaatattaattacgcaattcatttttttacatattggaataatttcagtaatcaatgtattcattgtaattgtcacacgacttaaaggcgttccaatttcatattcatttacattgctaaacattgatggatctacaaccaatatacagacttctgttatttcttttgctaaaatctttgatctcagaggttcaattattgtcatatccgtactttcactaaaagcctcatctaatgactgtcctgccaggataatctttccacttgcaagattaataatcttttttctcgtttctccaaaaactgatgaggtcaattcagcaataaaacttttgtcatctgcatagagagatactcctttactgaacagaaatttttccaaatcatctttttgaaaaacagattctttttcctttgaaaaacgttcaaattcttcactgattatttcatctgctcccaaaatatgtttccactccatctgcttatataaaattccgcataagtgtaatataccttctaagttaaactcaattctgctttgaaaaagccttaatggatgttccgcaattctgttcttattatcaacatcaataaatacaggaataacaagagaatcatactccgatgcgtataaagctccagcttcaaaattcaaccatggacgtgaaatatcttctcttgtcacaagtataatacctattttagattctttcagtgccttatcaatttcctgaatccacattcttccatcagtaatctgccttgaacagaaaattatttcattttcctcaaatattttattcagcaaatctgaaagaaaatccgcacatgttctcgctttgttcccactccagcttataaaagctttatttttcttctgtaatattccatccatcgtgttctctcccttctatacataatagtcctctaataatctctaagcctgaatttctctagcttttaagatgcttatatttttcatgagggctgactcaaagtacatatcatattttttggctcttcattaggatgtgtggtatagaaaatcggctcaaagccgtataaaacttgaaaaagcatatgggctctattaagatttttttgtctagaaaaaatcgtaaaggaaagagtcaccatatgctcaacaaaaattctatcaaaactatcctaaatgtcaagcacacttgtattgataaagttactattctcgcagatacctctatcatgattgaggtgcatgctaccaagctgcacttgctaaacaaaacaaataatatgtagcaccgaaccgccccatgtcatcacatgaggcggtttctatcttgcctaatccaattccttctccgccagctccagcgccgaagcaatcacagcatccatatcataatacttatactcgctgagagcggtacggagccggtgatccgtgtgatggttgaggcacagagtgatgagttgtgcgcgaagtatgtggatgagatggtgcaggtgattcatgaagaaggtcttatgtgataaagcagggatggattaatgagtgaaaaaaggattgcattggagagcgataaaaaatatttggaaaggaactaaggaaaatgtacgactatttaattgttggagctggtttatttggatctgtctttgcaagacaggcaacagatgcaggaaagaaggttcttgtcattgacaagcgaccgaatattgcgggaaatgtgtatacggaggacatagagaaaattcatgtacataagtatggggcacatattttccatacaaacaacaaagaagtatgggagtatgtgacaaagtttgcggagttcaaccgttttacaaattcaccggtggcaaattacaagggagaactgtactctctgccatttaacatgtatacgtttaacaagatgtggaatgtgattacgccacaggaagcagctgcaaagattgaggagcagcggaaagaagccggtatcacagagccacagaatctggaggaacaggcaatttctctggttggcaaagatatctatgaaaaactgattaagggatataccgagaaacagtggggacgcgattgcaaagatcttccttcctttatcatcaagcggcttccggttcggctgacatttgataacaattattttaatgcgctgtatcagggaattccggttggcggatatacaaagatggttgcaaatatgcttgacgggattgaagttcgcctcaatacagattatcttgaaaataaggatgagctggataagctggcagagaaagtggtatatacaggtgccattgatgcatattttgattataaacttggtgcactggagtaccgttccgtccgttttgataccgaagtgctggatactccgaattttcagggaaatgccgcggtcaactatacggatcgtgaaaccccgtggaccagaattattgagcacaagtggtttgagtttggtaaggatgatgaaggaaatgacattcctaagactgtcatcagccgggagtacagttccgaatggaaagtaggggatgagccatattatccggtcaatgatgagaaaaatggcaagctgtatcaggaatataagaaacttgcagaagacgagaagaacgtgatttttggcggacgtctgggtgagtacaagtattatgatatggatgctgttattgcatcagcactgggattgtgtgagaaggaattggggtaaaagtttaggatatgaagcattacagagaaattgatattctaagaggcattgcaattataatggtttttctgggacatgctgtgatcgtatatccgattaatttagaaaatgtggcatggtgcagaggactggtagcatttatcagtgcggtgcacatgccgcttttctttgttgttgcaggattttgctttcatcagaaaaatacatatggagatatggtacagaagaaaatacaaagattgcttattccttatacagcatttaatttgatggatatgtgctgtcgactggctttttcaaaattggtgaatcggccatgtgggatcagagagagtctgatcaagattgtattacatggtggggaatattggtttttatatgtattatttcttatgtgcattttgtggggattgttccagggatgggtgcgaaagcgtatatggctgcaggtgattgttgggattggagcgattgctcttaatatgttgcctgtgtcatctgatactttcaaggtggattctctgtgcaaatattttatttttttctatgctggttttttgatacaaatctattttgaaatttttcctgaatggaagaagattttggataatacaggcgttcttataataggatgcttggcttgggggatggtatttgtggcatggtatatatgcaaggttacttttattccgcaactgtgtgtcagtgttattggaatttttgtttgcgtagtgtttgctataaaaatttgtaacataaggccgggattggtcttggcagatataggaaagtattcgttgcaattatatctgttggatggttattttctgggagtgtcgcggacagttttggtgcaggtgttggcttgcacaaatccacttgtgattgtggcagggaatactttatttgacttggcgggagcttttgggacggctaagtatgtgttgatgaaggcgaaggtgcttcgggttttatgtggggaaaaataatataattttttgcagggaggattatgtatggattttcaaattgtaatggagttatcagcagttgctacaataattggtgtaattgtttcatatttcacatttcataagacatctaagttgagttacattacgcaagaaagaaaagaatggagagctgatatacgaaaaattgtggatgagttagaggtatgccctttttcaaaaaagaagcgggttttaacaaaactcaaaacccggattaatacatatggaaaattaaaggaagatgttggaaaagattcgcatatttggaaacagatcgaaataattgaaaattgccgagcaaaagaatatgagaaacagaaagataaattaattctgtttttatctcttttactgaaagatgactgggagagagcaaaaaaagaagtgattggggagccggcaaagggaataattacggtatgcttgtcatttgcaattattttttcctggattggtatatttcaagcaaatggaataaacataagagatgtcaaggaagtacaaaaaggtattatttatacgagccctgggatgatcttaattattatgggggtgataggttgttttttgatgataaatgtgttgaaacaacattgtgaaggagagatagtagtgattgatgtgatttggacaatggcacttatatttggtgtattgatattaacttttggaaataagctatccatttttatacaagcagctataggaatgattattttttctggagtgttaagtttgttactcgatattggaaaatatgttcaaggaaaaaggtataaatcatatgtagataaaattaaaggggatgaaaaaagcggttcaaaatagctactggttcaaaggaatggcattgagtaagttagttaaaataaatgaatagaaatggatggaaaagcagaaagagaaatttgacttgtgttaggtctagaggggcatcaatttgatatgtggtcatgtataaaaaatatttttttgaaaatactagacataaataatgcgataattttttgaggtaatatcatgacatcattaaaatatgaattaagaggatttgatggaattattttagatgaagatatgtggatggtattggaaagtcaatatatatctagaattcggttgacaaatgactttaaaatattagaaattattttgaaagagaatatattataccgtaataatcaagagccgattgaaaaagcggtgacagaaatttttgtaaatattttattgaagatcaagggacattttcaatgtccggaactagttttgacagatattatgggggaagacaacgggagaagtgaaaatagaatattcatagcaaatcctccgtcccctgctagattaatgctaaagactagagatgtatacaaaaacatcgttgaagataattttacaaaaaatgcagaggtggaatggcaaattatctatgctatgttgcacaatgaaaacaaagttgtatcatttatgagtttatacgattatctaatggaaatgttatggcaaatacatcatccttcagacgaaagagcaaagcaataccatgtgatttcttatctggaggaacataaagaacagtatggagatgatttaatattttttaaagttaataaaaataataaagaaaaaacagtggatatactgacgtatcggagaaatgaaattggtcatgcgagaatgaaaaacgatttggaagaatatagaaatttaggaaaacgtattgatgacggaataattagattaactttacaggttattaataatgttcttatggaacaaaaaaagctatgaaacagggggctatagtggctcagttgtcaagacaaaaatctaagatttttataatgaactgatatggtggggtggcaagaggcaatgccattaagccagttgttcgaagttttgttcgatagctcagttgttgtcaattatccgatattttaaactcaaaaagccaaaaacaggtatgccaaaaagacagatgctgtccatctgccaaaaagaaggatattcagttgcagaacttaccgatatccaaaatgaattgcgctgattccacggagaggccgttgaaactgccggaacctgtctttcactgcgtggacatatttcatcatcagccggataatatcgatgtgcctgccggaatccctgcgcatgaagaactttctggctgtttttaatgctgaagaaaaaacaagaggtgcctgacacaataaaatttttataaaataataaatacgtgtatacgaattggttgaaatatgataaaatgcaaggaaaaggacgttgagaataaatatagatgaaggaaaaataaaatgaagacgataagcgataagatatttgaattattaaaagaaaaaggtatgagtcagaaagaatttgcccagaggacagggatagcagaaagttctataagtgactggaagaagaaacggacaaatccggttagcgataagatattgattatatgtgaggtattaggtgtcacaccgtatgaactcttgtcaggagcggagcatacaggaaccagaagtaaaacaaatgaaatgtatgtatttacaaaggatacggaactggggatgctcatagagacatatcagcaattaagcgtagaacagcagaaaagattactggggtatatggatgcactgaaggattaaatttttgcgcaagaatacgcataaacggataaattatgaaacaaggggtatgaaaaaatcggaagaaaagaaagagaatggtatccaggagcaatttatcatttaatggaaagaggaatccgcagacaggagatttttagagaagaaacggattactatatatttattgcaatattaaagaatgtaatggaaaaatatggagcaaacctgcatgcatattgtttgatgacgaaccatattcatctgttattggagacatatgaggagaaagttggtaagatcatgcagaaacttgcaggagattatgctagaacattcaatagaagatatggatataaagggcatttgtttgaggatagatataagtcatgtctggttgaaacggatgaatattttctacagacaagcagatatattcatttgaatccagttaaggcaaggatggtgtcgaatccggaggattataagtggagttcatatcgcagaataattaatctatgtgatgatggaataacaacgagtcagaaaacattgtcatattttggaaacaaaagcatatggggatacagggaatttgttgaagatatagcaaataaatatgtggtaacagaaacggagataagaacagtgatgggggaagatgaattatggctaccgtggtaaaaagttttgcaatacaggggattgatgggtataccgttgatatagaaataaagacgctggaaggacaaccgctcattaatattattgggctgggtgaccttgcagtaaaagaagcagcagagagggtacaggcagcaattgatgaaaccgggtatgtttttccaaaaaaacgtgtgataataagccttgcaccaagcgataaaaagaaaagtggatctcattttgatctggctatggcaataggggttttacagcaaaatgatgatattgcggcaaaaagtctttcagattatgggtttattggtgaattgtctttagatggccgattgcgggcctgcaggggaatccttcccatgatcatagctgcaaagaaaaggaaaataaaaaagcttattgttccatttgaaaatataaatgaggcaaaattagttcatgggatagagaccatagggttgcatgatttgagagaagtgattcagtatgtagaaggaaaaaatatagaagcagagcaaaaacaaatggtgattatcaagccagatgatagaaatgaaaaggtcatggatttttctgacgtaaaaggacaagcagaattgacagaggcggttatgcttgctgccgcaggtggccacaatatgttaatgattggggagccgggctgtggaaaaacaatggtagcgcagagaattcctacaatattgccacagatgacagaggaagaatgtcttgaagtcacaaagatatacagcatttcaggaatccttgagaatggccattcactaataaagaacagaccttttagagcaccacatcataatgcgtccttgaatgctttgattggcggaggagtgaatgcactgccgggagaagtttcattagcccataatggagtgttgtttttagatgaactggcagaattttcaaggcgcacattagatgcgttaagacagccaattgaagataagagggtatgtatttcgagagtgaacggaacacatacctttccatctaattttatgtttgtgacagctatgaatccatgtccttgtggttattatcccagttcaaagtgcagatgtacggattatgagataataaagtacagaggaaaaatatccggacctatcatggatcggattgatatacaaaaagaggtaaagccggtgaatttttttaatctggaaaatcagaaagagtctctatcatctgcgtggattcgagaaaaggtggaaaaagcgcgtatgattcagcaggagagatataaaaatgaaaaaggtattaattgtaatgcccagatgtcgacatcactcattcagcaattttgtgtgttagatgaagaatcattaaaactgttaaagcagacaagcgaaaaatatggatatagcgcaagagtaatacacaagttgttgcgtttagcgcggacaagtgcagatttagatggagaggagaggattcgacagttggatattgaaagagtgctgtcatgcagagaccttgataaaagcaatagtaagatgctggtggtaagttaaatgaagttgaagtattggttatggttgacacaaattccgtatatcggagtggttacagcaaacaaattaatggattgtatgggtgacccgcagatggtgttcgaagcggatgaaaacacattgcggcaaacaggaatattgaataaaagacagttaaggaacatagtagaaaatcatgacatggtgttggcggagacaattataaataattgcaggactttagggatatctataatgacaaaagcagatacatgttatccagacagggcaaaatatttcgatgatgcaccgattgttttgtattataagggaacgccagaaagaaaaaaacgtgcggtagggattgttggggcaagaagatgtacacaagagacaaagaaacaagtaattaagattacaagtcagtatgtttcaaaagggtacagtattataagtggtatggcaaaaggagtagattcatatgcacatactgttgcaatcaataatgatggttatacagtagcaattgttggcaatggccttgacatatgttatccaagtgaacacgataagttgatgcagaaaatacaaaataaggggttattattatcggaatatccaccgggaactataccagcaagataccgatttccgcagcgcaatcgtcttataagtgcatggtcggatgaaatcgttgttattggtgctggaaaaggcagtggtgcatttataacagcagattatggtgataaatacggacataaggtgttgtatatgtgatatggcataaataaagtaagtctattaaatgtggtaaattttgggtttccaacggtgttgttcaacaatataatagcaaaataaatatataggggtatagttgacgagaaagcgatcataaacgggacacaaaaatagaacaaatgtacgggaaaatatctggtactggaaatttgaaaatgaaaaatatgcaaaaaatgatgaaaatgtttgccggagatagaatggcttagaaaatttagttgtggaaaatggaaataatagatataatatagaaaagaagtagtttccaaaagcggataaggggctttattactattttgataaatatatattaggttatttgaaatctcgaagggggatggatctatgacagcattaagacggagtgcaatattggaattggaaaagataccggaagataaattgtcttttgtaatacagattatgcaaggcgtaaatggattatataatgatacagataaggagagggaagaagcgtttgaacgattggaacagttacgaaaaaagggtactgttacagatgataaggcagagttagcttcttatagggaagaaaaatatggcaggtaaaattttgattgatactaatgtattacttgattatcttttggaaagagaaccattctttgaggacgcaaagaatgtgattttgttatgcatcaaaggaaaaataaaaggatgtattgcagcacattcaatatctaatatgttttacatattaagaaaagattatacaactgaggaacgcagggaaatattattcaatctatgcgaaatctttgatgtagagggtatagataagataaaactattatctggtctcgtaaatgataatttttctgattttgaggattgtctacagatggaatgcgcaaagagttatggggcagaatatattgtgacaagaaatgtatcggattattctgtatcaaatataaaggcaattaagccaagtgattatttaggattacaaaaaagaggtgcctaaacaaaagccaatgccattgaagccagttgtacacagctttgtttgatagcccaggtgttgtcaaagaaaatgtcaaactattgataattagcatttttgtgaaagaggcaattgaggttgctgagggtggatctcttgttacaatgggaatcacactgacttatccttgcaccggatatggatatattcggtttgacaaatgagaagaaggtattgcaaaaaaggtaatcgaatttaaggaaaagccggatcttgcgacagcggagaagtatgttgcaagtggagaatatgcatggaacagtggcatgtttgtatggaaagcttctgtgattttggaacagtttaaagaatttcttccagaggtgtatgcgtgtctggaaaaaattggggatgcaatgggaacggacgctgagatggatactattaataaaatttatcctgttatcccaagtatttcgattgattatggaattatggagaagagtgatattgtgaaagttatttctgctgatatgggctggagtgatgtcggaagctgggacaaccttggggtgcttcatgatacggatgccaatggaaatattgtagctggaaatcatttggcaattgatacaaaggattgtattacatattcgaagaagcgcttgattacaacgataggagtggataacctgattattgttgagacagaggatgcgattttggtgtgtgataagaaccgggcgcaggatgtgaagctgattgttgataagttgaaggaagatggacataacgaactattatagaaaacagaattggagaagcgaagaaatgagttatatggagacatacaccaagtggtgcacagacaactactttgatgaggattccaggaaggaattaaaggcgcttgaggggaacgatgaagaaatcaaggatcgtttctatcgtcagctggaattcggtacaggaggcttaagaggagtcatcggtgcgggaacgaaccgcatgaatatttatattgttcgtcaggcaacacagggacttgccaattacattatctcacagaatggacaggacaagggtgttgcaatcgcatatgattcaagaattatgtccaaagagttttcggatgaggcagcgttatgtctgaatgcaaacggaatcaagacctatcgtttcgagtcacttcgtccgacaccggagctttcatttgcggttcgtgagcttggatgtattgcaggtattgtaattactgcaagccacaatccacgcgaatacaacggatataaagtatattgggaggatggtgcacagattactccgccgcacgacaaaaacattcttgcagaagtggcaaaagtcactgacttttcacaggtgaagactatgatgaaatctgaggccgaagctgcaggactttatcataccatcggaaaagaaattgatgaccgttatatggaagaactgaaaaaacagtcgatccacccggaaatcatcaaagcgatggcaaaagatatcaagatcgtttacactccgttacatggaaccggaaatctcccggtacgccgtgtgttaaaagaacttggttttgagagggtttatgtggttaaggagcaggaactcccagacggaaacttcccgaccgtttcttatccgaatccggagtcaccgaaggcattcgaacttgcactccagctggcaaaggaagtagatgcggatatcgttcttgcaacggatccggatgccgaccgtctcggtgtctatgcaaaggatacaaagagtggcgagtatgtaagctttaccgggaatatgtccggtatgctgattgcagagtacattctgcgtgagagaaaagcaaccggaacacttccggcaaacggagcactggttgagactatcgtaacaacggatatggcaaaggcaatcgcaaaagcatatggagtaaaactgatcgaagtgctgactggatttaagtatatcggagagcagatcaaattcttcaagcagcagaatacatacgaatatgtctttggcctggaagaaagctacggatgtctggcaggtacttatgcaagagataaggatgcctgtgtggcagtcatgatgctctgcgaagtggcagcatggtgcaaatccaacggaattaccctctgggatgccatggtttccctgtatgagacttacggctattacaaagaaggtcttgagactatgaccttaaagggtatggatggagcagaaaagattcagagcatgatgaacgagatgcggaacaatccgccgaaaaagattggcgcatgggatgtcctggcacttcgggattacaagaaagatacaagaacagaaatcgcaagcggcaaagtgacaccgacaggtctgccggagagcaacgtactttattatgagttaagtgacaatgcatggtgctgtgtacgtccatccggaacagaaccaaagatcaaattctactttggtgttgtcggagcagatatcaaagattcggaaaagaaactggatgagctgcgcaccgcgatgcttgcatacgcaggagaataggatgcgataggagcattggaagatgagaaacaaggggcaatgccattaagccggttgttcgaagttttgttcgataacccagttgttgccaaatatccgatattttgaactcaaaaagcccaaaaacaggtatgccaaaaagacagatgctgtccatctgccaaaaagaaggatattcagttgcagaacttaccgatatccaaaatgaattgcgctgattccacggagaggccgttgaaactgccggaacctgtctttcactgcgtggacatatttcatcatcagccggataatatcgatgtgtctgccggaatccctgcgcatgaagaactttctggctgtttttaatgctgaagaaaagtcaagttcatagagatacttgttgctgccatcccgtttctttttccggttttcttctgccgcttcgtttgcgataaaaatgccgaaattgtacagaatcaggcgggaatagatttcctgttttagaaattccggcggttttgatcttaacaacgcgaaactgcaggaaataaagatgactgtggtttttcctgagaagctcataaaaatgaggggtatttttactgggattgatgtagcggtaaacatctgactggcttttcataatatttgtggctttatccgtaaaaaagcgctttatcgtaacgtcgaaatcttcaagatcatccggaaactcagatgcataataagaaagaatgctttttggggaagatggtgattttacacggaaaacgtaacccaggtttttgagctcacagtggaacaggagatcataggattcgtaaccgcggtctgcagttataatatatttttgcggatcgtcgggtgtgaaatgatccagcatggagtggagcgcttcacgctcatccggctgctgtccgggctgtatgacgacatcaaggaaggctttgctgataacatcaacaaaaccatttaagtgcatgtggttgtaacctttatagtcgataagccggggcttattatagtcctcgataatatcagaattggtagcatagacaacgtggcacccatcgcaggcgagaatacaatggtctttgaatttgtccgtagtggatggaaaagaagaagagaattccgaaaaaaggtattcaaaagcagagagggaaatctgtctgcggcgctggcagaaagcagactgtgaagggataaggtcagggtccaggtcaaagtaatccatgatctcatcattcgtgctgcctttccccatgcttatgatcagacgcatggtatcataaaaagatagtttcccaagatgctggcgtgtaaaatcgtggccaggatttttggaaaagagccagtgattgcatattccgcaaaaacagagcactcgctccgcatgagcagagcactgttccgctaggaacggatcattgccctgttggttaataaagttacttgctttctagtagtggccgtcataatcgatgtgataattattaggcacgcctaatgttgtggcaaagatatgaaatctcatgatttcactggttgtaacatccgtcagaagtccaggctggtcgccaacccagtcgatgtacatcttttcaccaggcttgcgatttaccgccattgaaatttttgtgtcaccatagtttttctgaacaaaacgttgatagtattcatagaactgggatttttcatatccatctggattcttttctttgtagtccagccaacagaatgaaatatttactctactgtttggggcatgaatacgatcaaagtaatactgaaaatcaggaagtggaacttctttgcgttgaagatttttctgtgggtaaaagaggttctctacttcttttggtgacatagcttcaagctcgtcaatggtgagctcaagagccttatatcgactcatgatcaagttaagagtgcttgatccgattcgaaaacgatccataacagatctggttgggcacttattcagacgcatctgaatagcaccaataatagtgttgtagtcctgcataaaaatgcatcctttcgtaatctaaaaataatgactacgaaaaaactataacactttataagaatgcgtgatccgatgaagtggaaaagtgttccgttacgaccggaaacactgatccgttgctagcggaatcggtgatccgatgaagcggaatttgcagctgaatcatctgcgaccgtattattactttaaatatatccttacagagctgtcgaaactttgtgacgaaagaggaaatatagatctggcaaaactggcttatctcatgccatggtcagatagtcttccggacgaatgctggaaaccgcgccgcccataacaggcggcgtttgttttaatggctggcgcatgatttgacgtttacgttaaaagaggatttagactcaaacgccggtaacaagcccttatagggtgtgaacaaaccacaggttaagccggtggttctgattatatatttttcttgttatgttatgtttttgtggaattgaaacgcgaattgtcatttgtatgaaagttacttgataaacgatatgagcaagagtattatgtaaatataatatagctgaaaagattttataaaaatgatcagagggtgagtcaatgttatggagtattgtagaaactgcaaaagcaaacaggttaaaaccgtatgaatacgttgtccatctgttaacagagataccgaagcatatggatgacaagaataaggacttccttaagaagttgctgccatagtcacaagaactgccgtcacacatacggaagccggtaaaaacagaaaccaagagataaccatgctgtttttcacggcatctaatttgtcaaggtacacgggttgcaccgtttactatgaaagtggttagttatggatcaacagattctggttttgaaggaagtcaaatatactttatattacattagtattctttgcagattaacacgtatagcctgatatatggtggaaaggtaatttctgatttggtcaaatatgtgatttatatagatatgtcgatgtatgatgaacctgtttcttccatatatgtttatttttctcttgtataatataaaataaaattatgactttgctataattgttcgcttactatataaaatgaaaattgcatgatacaataactgtaaaaatagtataatctattgctataaacgaaagaaatggagtaataagaatgaaaggtgcactcatatttagaattaatttggaaaataaagcagatagttttgcaaaagtcagcaattttatttcgaaactaaatgcaaaagaaattatgtcatctagcgatgtgcgtggtgttttaagtctttcgtatagtaataataaaagtgattttgcttcagtggcaaggtatgcttttcgtaagcaagattcttttaaggaaattaataagccggagcggttaggtatagtagaagattacgatgtgtattattgcatatggataaaagaagatgcggttagagatgttgtcgattttcaatatgattatttgattaaaaaatttttttcaaataaaaagattttttcaatcttgataggcagtgatgacatgtattttaaggcgtcacattatttatatagtatgagtagtgaggatgatgcatggtataatagtgttttttattggaaacaagatgattcattgattcgattgcaaagaaaaaatattatccgttttaatgattttatgccatttcagtatttttcaaaagaaaaaaattcgattcgtagaaatatgaaagaagtggtagagaaaagagatttcttaaaagcgatacatgataagaagtatgaattagatatgatatctccgattttaagaggtagtattggaattttacgaaagttatttaaagcgcttgatcaggaaacggtagaaaagattagcgattatttattggggggagacgtttttacttttttactcttttgttatgcatgtttgaataataatagatggaaagaaatttcgtataatgaaattatagtatgctatgataaaatacaagaattttccattagttgtgaacagttaatggaaaatgttgtaaatcactctagtgctaaggccggaggtgtctctataagatttcatgaaggaaaatctgagtatttaagccgaagatatagtttgcctaaagattacaataaatacatagaaattcttataactgactatgcaggaaataatatagggggaaatatcgctcagaattttttgaacaaaatttctgatgaggaacaaaaatttttgcagggattaacaccgattgatttctttgttgatttggataacagtaacgaaaaaagtattgatatggcaaagcgattgaacaggtataatattagccccgaacatattggtcagcatattggattaagagtgtttaagaaaatagttgaagaaaataatgggcaatttggattttatagtcataaagaacatgagataagtagtggcgaaaattataattatagagagtatacgaaaatggggatgcctggaacgggatataccgtattattcccaattgatttttatcagataagcttaaagcaacaaacacaaataagtatagacgtgaatattgatttggagagcaatattcatgattatgtggaagggtatatttgctcagaagagaatttgtgtaatggacttacggtttttgaatcgcagaatgaaaaggaagcagcgataattgatttggcaaaggcatttcgtattgaaagagtagaaaaggggaaaaagtgtatcaagtacatatctgctaaaggaatgaataacaattttgcagaatatatttgtaaaggactgatcattgcatcatttgatcagtccataccggattatgttttttataattgctcaaaatcatttgttaatgcatttctgaagacgcttgcagtatattgggaaaataacgattttatggagtggtacaaaaagaatgaatttgttatcgctttatatacagaaattccggtaacaagctgttttgttattttaggaaatcgtgagaaaacaatatgggccaataaagtaaattgttattcggaaagtgagtatgcgaatgaagaatggcttgtgggagagaaaagtctaaatacaagaggcacagagcattggaaagaaattccaccatatgatattttgcatattacaaagcaagataagtcaactatttttgaaaaatatgcaacacaggtcttggaaaatgatatacaggaacaatcatttggttgtaaactttcagatacacatatgcgccttgggtcaactatacatatagatacattttatgaagccgaattattgtttagcaatcgattgtttgcaaaccgttttgcctatttattagttaatgatataattaaaaaccagatttttgcagattccgataaaattactttgtacagttatgcattatattcggagagcttggtcgttgaaatggtggatctgttgacggctttatatgaggataaggacattgactatgtgattttggagagagaatctgaagtgcggggcgctgagcatatagatagaattagatatggcaaaagttttgaaagtgaacaagcgcgaaaagaatattttaaagatagaaagcttatttgtatagtcccaattaattcgacaatgaaaactcatgaaaagcttttgtcattgttcgtggagaaaaatggggaagtatgcgagaaaaatattatacttaattacgcacttgttttgattggatcaaaagaaccaaatagatattggataattgacaaggagaaaaaatcttttaaaaagttgagcttgaaaatacagcctattccaaaatatttcatagaggtattggttgactattatgaagcaaatgattgcgaactatgctttccgcctaaaccattagatgaagttcctcttatagaagtaaatgctgcttcaaccataccgaatcagtcatttcggttagggcaagatgtggaagatgttgaggtaaaatatgagtggttgagaagcgaagaaaaaaaattagaggaattaaaagatgtactgttatacaagcatactgtgcgcggagaaaatcattttttgtactattttaagacggatcagttattcataaagcaaaaagatagtatagttacatggctgagacagattgctcaaaaattaaaattgaatacaagggattatcatattttattttgtccggcacattatagcaatgcagggtttgtggagaacgtcaatagaatcgtttttcgagatgcggcattgcttattagagtggatattgataaagaatatagaagcaatgtacgcgcgaagtattctaatgttgccaaattgattgagatattggaaaagagtattacgacagataggacgattcgcatttactatgtggatgacagtattatcactgggcggactttctatcgtgcaaaaagtttagtgtctagtattgtccaacaatacaaagaaagatctaacaaaatagatattcatgtgtttgaaaaaatttttgtacttttagatcgaaattcgaatcaaagtaggttacaatatatagggtgctgggatagcgccaataagagtgaaaagcaaatagaagataatttcttttgctataaaactttaaatattccatcgatgcgcagccatggagattcttgtatcctgtgtaagttggagagagaagcggaacttttgtactcaacgtcttcgactcagaatatgattgactattggaaaatgcagcagaaaaaattttcaattagcaaattacgtgatcatttggaagatgtggatggagaaacgattgagggaaacaaggataaatcatttaggaggatgatctgttatcatcttgcagagaccacattattgaaaggtaagcagtcaaataagaaggaggaggtaatagaaaaaattctccgtttattaattgtagattataatggaagacgtgatgagagtggaaacgaagttgcagttgaatatttcctttcttatttaaagattctatcaagaccatttattgtatttgataaaacagttaaggaggctatttttgatatacaattggttctttctgaggcaatattaagtaagaaagaaacgaaagaaattcttcaggaaacgaaaaataagaaatatttgattaagcaaaaagcattatgggaagaattgatagatgacatagtaagagagcaatttacaaaaaggaatcaagaagacttattgaaattacttatgaagcagttaacggaaatgaagagtaatttcttcataagaattgaaaatattaagaagttgtcgctgtatgcgcaaagcattgattcggaaaaggatagagatctattttatgagcgttttttgcaacaaacgaaaaagctgttaggtcttagttcggatacgagcaaaagtgcgtggtttagccgacagatttccggtcatgaaaatgaattgggattatcacgggatgtgttgggccgggtaatccttgaaaatacgcgggcatactatgatggaataaaacggttaaactctataggcacaagtgatgtgaatgaagaagtagcaaaaccacaatatagagatttttgttctgtattaaaggatctgcgatatattggggatgataaaaatttgacaaagagaggtgcggaagtagtaaaagcatcaatttctttacttaaaatttgtaatgacgatattgctactcaaggtcgcaaattgtctgaaagaaaaattgaagaattgtgtgatcggattgttcgcttaatacaacagattttaggggctgatcgggttcaattgcttttggaatgtccgttagaatgtaatttatgggtagaccgattaaaaaatcaatacaatcaaattgttaagcggacattaaaaaatgaaacggattcggctgcgggcgatgaactgcttcttccattaatcaatgaaaaagaatattccgtaattgcctcaagcaaatccaaaagtgatagaaccattgaaaatgcggagatcgctattgttaaacgtatcaatatgtattaccaagctaaaaatgatttgaagttggaaggcgtgtatgtcaatgaacaggataagtttatggtttgggaaatcggaaatacgaaacatcaattgggcgatagcagaaaattgttgatttatgtggagttccctgaagtaagtttgccgacagattggcacaagattcgaaatttactttgtatgaattatgaaatgcataaatctgtgttcaataatgaggttatcaattatctgtttgagttgcttttggcggacaaaagaagaatgctcaatgaacgtgaaaaagcgcattcacatacgacggagaaggtgagaatagctcaatgcgagtgggtgagaatgaatgaaaatcaaagtgtccatagatcatttgttttaacgttgctttcggatttaatggttagtgaagtatatagaaatagcttaaaggatgagtattataatcaggatgcggatttccaatcctgttcattgaatgatgttttagcatcaactttcgaaggaaaaaatgctttgattgaggtcttagattcaacgcacgttaatcgatgtaattgcttgcaagtagaattcctaaaggaagactctttttttgaagatgattctgctatgaatttagaggattctttgattgcatatgcagtagcaaatggaaaaaatgagatttttctattgattatggcattgataatgaatgcaggagttgctgggcgaggaaaaaaggagatcatagaaaaggaacagaaagagagaataaaagtatatgtatcgaagacttgtgatggaaatttaagaattgcaaataagagttcggttacagaacaacagattgaaataattaatgaggaattgcattatccgccgcaaaagaatcagggaatatctttgtggagtgtatcaagatatattaagggtattttaagtattatcattaaacataagctagatagcgtcgatataaaatgggaggaatatgagagtaaacgtgtaaaaaatgagttattgaagttaaagcaatggatggaaaagtatttgagtaatgaatatgatattagtgtttgtagaagaacaagaatcagtgaggagaatcaagaagtttttttctgtatagatattccgttatatgcagaaaagtatccggatgcattatttaaggaggacaaaaaatgaaacttgcaatattagaggatagaccttggattgtaatgaatacaataaggaaaatgaaatcaattacccagattgaggaaattgatttgctcttttatgagaattcttttgaacaaaaaggcgaaattgagcagagtattgtttcagagtgcaaagaattggatgttcgattgattagaattacggagaatgattttgagagtaaaatgaatgaattatatagcgacaaggatagaattttcttttttgatttagttttggatgataattcagatttctttgaggaacgtattaatgtaatctatgcggataatagaaaagctgataaaaggatatggttttacactacatcaggtaaatataatattactaagataaaaaatatgtttggaaagcaatatataccagtaatagactatgatgtaaaacaagatgctttagtttttgatgagagtaagttgacagaaattttgagtcaatcataagggagatagcaacatattgatgaatttgtattattatactagagttgaaacaatgagatatattttgatgaatgcaaatatatttgctaccaatataaagtatatgaatgattctgaagagtatgcaaacggtctaaaagaattatacaagatctatgaaagtcattctgatgggaagttggtatcttctgaaaagatagaagctgaattagaaaaggatattcctatatattcgatatctttttcgggggcaagagatttacttagtcagtggtctatgtatgcaggtgaatcaggtgtcagtattaagatgcaatttgacgggactgagaagtataaagtttatgatttgatttctggaaaacggaaacgattagttgatggtgacacttctataaagcctcaaaaggtatggtattgtacagaagaggctatgaattcggatgattataaaagagtgacggatgaaatatggaaagaagcttttttggacgaaaatgatgttgtaaaaaatgatacggaaggtaattttggtgattacagtagaaagattacgccttatataaagcgtgcagaatttcaagctgaacaagagtataggattgtgtttgagaagagcaagtggaggaatactaagtgtgattttagaattgattatcgaaatagtagaaatgtgttaaaaccatatttggatgttttttgtaaaaatggctggcctattcatgaaataattattggaccggggtttaatcaaaaagttgtatttgaaagcgtgcgacattttttgaacaatgctaagttatcagtgccaacgttaggcaatgatgcttatttgatgcgctttgaagaatatttagagttatgtggaacggtaccgaaatgtataaaagatctttatgaacaacaaaaagaagaaattgcaaatgcaccaaatattcatcgtttttttactaatataagaaattctattattgaaaaacttaagatggaaaatgtagataacgaatttttggaaaaaataagtaaaacggagtttactaaaccggggatcattttaagtcgttctcgaattccatatatttttgaaaattaaaaaatatatagggtttggtaatgggatattcaagaaaacaatcagcataggaaagcaggattttgccttgctccgtagacaaaattgtttttatattgataaaactgactttatcaaagaatggtggaatgtttcttttcagtgaagtatgcgaaacgtttggatttaagaggtagatatggcaaaatttgatggcattgtttttgattataatttgcaaatgaatgaatttaatagcgagcttgctttgaataaagcattgaatcagaacgaacttgcatatgaagatatttctgagaaagaatataagcatgaaaattttggattctgttttagagatgatatccgggcaagtaatcatttttatatgcaaatacgggctttagatgagattgatgataaagaggcattgcttaatacagcttgtgatgatttggaaaattatgtgtttgcttgcaaatattgtggtgcggaggaagatgttgaggaacaggaacataaagcaaagcgcatgattgagttaattttagcctatggaggacaagaagtaatttacagaaaaataaaagaaatacatatggaaacaattgaggagtataaagaggatattgggggagataggtatttctttttagactttttcgatttgtatgaaagatgtggcgattatatgctttttataaaaaaggatactgatttagctttaaagttttatgaactggcttcactggattggtatgactttgcaaatcaaaaggattggaatattagtgaagcagataagggggatattgttgatagaatacaaagatttaccagaattaataaattgttgagaaatccaagaatagaagttattcaatggagtaaagaaaatagaactaaatttgcaggtgaggaaaattataaagatcaatttattaagtatatgaatagtttgaaaatcgaagatggaaaacagatatgcacaaatgcatccatattttttcacgcgttaaagaggatgagagataatagatgtaaatgtgaggaacttcgattgccgttgctattagcatattatattcaggaaagttcgttggaatatatgttggatgtgatgcggaagtatgctgatattactaaacttgatagtataaatagacaaaatatttttgaaagtattcgaaaaaaccatagcaaaacattaactccaatacgggagtatataaaccgggtagaagaaaatgaacaagtatttaaaaattgctttgatctgttgaaagtaagagggtatacaaaaagtattgcagaatttcttaagagggataattctgataaaacggagttagcttattataccagtgttgataccttctcctatatgctgccgtctaaggctgtggataaaatgttgggaagactttcgattatgaacatagcatatatgaatgatccgaatgagggaaaaacattgcaaaaatatttgttttcaggacaggtaccttttgaaggggatggaaagcagcgaaaaaatgcaaggtatccgtatgtgtatataaagtgttttactccacaaattgattttttaccaatgtgggaaatgtatggtgatcatgcacagggatgttgtttagtaattgattggaaaaaaattagcgaagcaggaacggatgtacctttatataacatgtgttatttgagtaaagttggaaaagagtataaagttgagcgacaatacaatatgaatttgaattcatgtaaagaaattgaaacaagtcttaaactattatctgatttgtgtaaggcgatagtgaaaaaagaccatgaaactttggagccgttacaaaatattttaaatgaaattttatatttgtttaaagatgcaagctattcatatgaaagagaagtgaggatttgctatcaatatccagaagttaattccgagtttgagcatactcctggagcatttggcaaattatatgtagctacaaatttcctgattaacttgaaagagataatattgggaccaaaatttttaaatagaacggatgtaatgccatatttgcaggaacaggttgatatcatgtgccaagaacttgatatgaatgtgccgaaaattacattgtcagatatagcattgatgtagaaaatgataataaacttaagaaataatgttcatattaaaagatgtaaagcggaatgtccgcgaaaaaaggggctgtcaaaagcccctttttcattatctccccacataaaccgaaatcaccccataggcaatttcccttcctgacttgaatattcttgtgactcgaaatcgcaaatccgtaaatttgggaatcatggttccggtacccggaaatcacctttttgtgcttgattacagtttctatttctatgggaatatttgtcaaggccttgccgcatctgcggtgcgtagcagcctttacaaatatccctgtagaaattatgattcagtatgcacaaatatagttcgaagttttgttcgatagtaagcgcctagtttcatggtggatttaaaatcatcacaaaatttgccataattatagatgatagatgccagcgaaattatccaatcgggaattggacaatttgaacaggcttttggaattgtccaatcaggaattggacaattagagacggcatataaaaaaataccatttaagttgagctggacgcattatcagattcttatgcgtatagaagataaggatgaaagagatttctatgagaaggaagcaatacggtctaactggaatgtaagtaccctgaaaagacaattccattccagtttatatgaaagacttgcattgagcagggataaaaatgatgtgatgcgtttggcaaatgaaggagctattccgcagaaaccggaagatattttacatacgccatatgtattggaatttgcaggactggaggataaagcatcataccatgaaagcgatttggaatcagccgtaataggaaaaatgcagaaattccttcttgaattaggaaaaggctttctctttgaacagcggcaaaagcgatttacatttaatgacaaaaatttttatgttgatctggttctgtataacaggcttttaaggtgttatgttttgattgattttaagattgatgagcttacacatcaggatttaggacagatgcagatgtatgtaaattattatgatcgctatgaaaaaattgagggagaaaatccaacaataggtattttgctctgcaagcaaagtgatgaggctctggtagatttgacacttccggaaaatgctaatatttatgcaaaagagtataaattatatttgccggataagaaactgttacagaaaaaattaaaagaatggttagatgaagaacaaaattgattcagaggggagagtgctatctatgggataggattcttccccctatttttataagctgtgatttctgttttttgtctgttgtgcctgcaccggatcgggctgtgtctgaccgaggtattggctcaaattttccagtttttggtttaatgattgaacctctttttcgcaattcttgtaggtggaagtcagttcatttttctgtttcatcagttcctgatattctgcttttagcttatcaacattcaatccttttaagtttatccctgcctgctcaagtacacgccttgcaccgccatatagaatgagctggctttcgtatcggcggaaatatgcgtctggattctttgactttttgtaggcgatgtgataggagcggttatctttgtactgctcggcatatttgatgatttctgcaaggtctttcatgcggtgttccagtttcacagcgctctgtttggcagattttccggcttcggttttcacagtaatctgatgcttcagctcggagagagaaccaacttcattatagctttgtgcagcaatcttcaaattctcgatagttgcccattgctggagtcctggactgccttggaatttttcatcagaagtatcaatgagcctgcgggaagagtagtcttttttcggaataacagattttcgctcacgcttcatttcgatgcgttcccggatacgttcctttgtgtattccttaccaagcgatttcgtactgccacggacaaaacgttctttatccagaggacggaaagagatgtatttggcagcaccttcttcaaaagattcccctttaatttcatatcctttggctctcattaaaagtaaaaaatcttcgtatgtggaagctgacttgatgcaaaaaatgatgtcccttctaagctgggttttccaagtagagccattctgatcagactgccattctttgtattttttaccacgttcaccacccggaatgatgatggaaaggttatgcgctttgcatagttcatcacttagtttccggatgtggtaatacgactgtttgcagtcgtgatatttgttatgctcgatgttatcagcagcacaaaatatgatgtgattatgaatatgtcctttatcaatgtgtgtggtgagaacatacgaatatttcccttctaaaaccttgtcagcaagttcttttccaatgcggtgagcttcctcataactgacttctcccggagcaaaagcctgtatcagatgataggctttgttaggactgttctccctgcaatggtcaagggtgtacttaaagtcaatcgctgctgtttctggcgcacacgcataagatgaaacatagatttgctcatctgttttgtcgggattgcagatgtaatctattgctttatcaacggttgctttgatagcatggatttttgtgtatgccatactttattcatcaactcctttacttcattcatatcgtcctgatagatgtttccggtactgtttacccgctttgcaatctgattcagactggagctgattcgtccaagctctgtattataatttcgcagataactgtaatcgacatcatacacatatccatataaaatcagtttgcgtaaaaaggctgacatgcttttcatgccggatgctttgaacttggtattgagaatgtattgctcatcatcactgagataaaattgcactggattagtgcggtttcggtttgccattgtgccacgtcctttctaaatttgggtacaaaaaaactgctgtaaaatgttcgatttttacaacagtctgtttcatgttttattcaattttgggtgtaattacccatagcaaattgtagcaaaaacggcaggaaaggtcaatgcatttcgaaggtaaaatgaagagtaatcgaagaaaaatcgagagagggttagggacacttccctatggaaattcatacgcacagacgataggaaagtgtgggaaatttcgcctgtgtcatgacacaggcagtgcttgctaaggttgtttttggcactcctggagggtgtgccggatgttttattagtttagaaaaagtaaataaagacttgacgtttaaatcttacacgcgtaagatatgaggtgatatcaatttcaaattttaaaatggaatggaggaaggcacatgaaaatacagagaaaaatatggaactatatattgatacttgtacttggtatgatgggcatgattacaattatcttctttttagttgagaaattgctgctgggggacgggagatgttatataccgcagagagcaattatgattgctttgatgttatgcgtgttttggcaggtagcattgataacagtggcatgtctgttaggaaggcggattaaaaagatttttcatggtgtagtcaaaatgatgatgacgatagtaaccgtttccggtactctttgtcttgttttgtttctcgcatggaattggttgatatatagttttaagtttgatgaaaaagtagagcaatatgatgaacatatcgctttatatgtgaataatacatttgtaagaaccagatttagatatccgcattatatgtatgaagaaaactggttaatcatgagaacgttaagtgatgatgaattgcaggaggcagttttgaaatatggtgatccagatgattattataattaacataggaaatttgatagaatttatagattcaaatttttgaaatacaatgggaaaaatttttgaattgaaatcttacaactgtaagaaaaggagatgctatgacgaaaaaaaagaaaaaaagcaggatatacattatatggctcgtgaatttatgtttgattacagctgtggttgccttttttgtatggtatgaaagtgtacctgatgtatcaccggagaaggttcttaaaacatatatggctcatatttcaaatcgagaatatgaacaaatgtatgaaatgattgatgcaggaatatctgggaatatcagtcaggaagattttgtgaaacgtaattctgctatttatgagggaattggtgtagataatattaaaattcatattacatcttatgataaagaacaaaaagagatatgttatgaaacatctatggatactgttgcaggaaatgtaacttttgaaaataatgtatcatttatacaagaaaaaggaacgtacaaattggtatggagcgattctttaatattcccagagttggattctacgaataaagtcaaagtatctgtaacaaatgctgagaggggacagattttagaccgaaatggacgtgtgcttgcaggcaagggggtggcttcttctgtaggtgtagttccaggtaaattggagaatagagatgatgctattagtcagcttgcagacttgttggaaatgaaggtggaagatatagaacggaaattatcagctaaatgggtaaaagaagattcatttgtaccattaaaaacaataccaaaggttgatgaattaaaattactgtcgcttgagccagataaagaaacactagctgaaaaagaaagacatgaaaaattattagaaattccgggtgtgaaaatttcagatatcggtataagggagtacccgctcggtgaggctgccgcacatttagtgggatatgttcaaaacgttacagcagaagatctagaagaacatgacggggaaggatatacatcgaacagtgttattggaaaaagtggaatggaaggattatttgaaaaagaattaaagggacagaatgggtgttctattactattgttgattcaaatggcaataagaaaaaaatcatagtaagcacgattgtagaaaatggaaaagatataaaactaacgatagattcgaatttgcaaaaagaattatatgaacaatttaaagatgataagagctgttcagttgctatgaatcagtatacgggagaagtattggctttagtcagtacaccttcatatgataacaacgattttattaggggcatgtcaagtgaaaagtggaatgcgctgaatgaagatgagaacaaacctatgtataatcgttttcgacaggtctggtgtccaggctctacgtttaagcctatcatagctgctattggattaacaacaggggcaattgatccagacgaggattatgggaatgaaggattgagctggcagaaagattcctcatggggatcttattatgtaacgacgcttcatgcttatgagccggttattctaaaaaatgctttaatttattcggataatatttattttgcaaaggcggcattaaaaattggggaaaacgatatggaaagttcattaacaaaactgggattcaatgatgtacttccatttgatattaagatggcaaaatcgcagttttccaatacagaaaaaattgaaaaagaggtacagttggctgatagtggctatggacaaggtcagattcttgtgaatcctttgcatatggcttgtatgtattctgcattttgcaatgaaggaaatatgataaaaccatatcttacatataaggaagatgcaatgcctgatgtctggattaaagaagcatttacaaaggatgtggcacaaactgttttggaggatacgaaagaagtcataaacaattctcatggaactggctatgcagcacatagaacggatattatattagccggaaaaacgggaactgcagaaatcaaagcatcaaaagatgatacaacggggactgaattgggatggttttctgtttttacaacggacaagaatatggagcgtcctattatgatcgtcagcatggtagaagacgtaaaaggaagaggtggaagcggttatgttgtcaaaaaagatagtcaggttcttgaaaagtggttttctggtaattagtataggtttttcgatggggatttcgggatgtaatgggaatacagaagaaccagtatcttctgaacctattgaaattgtcagtgagaaaggaatggatgacaattttataaatattccgatagatatttatgcggaagccacaacaaaaaataagctgaaggatatggaaacagtacgtaaagttgtagaaagatttgggaaatgtggatatgcggcagttgattgtgaaaatcgagttgatatgacacaaatacaaaatgtgatagatttttgtgattcggtggaaaaacaagaaaaagcagaagtgacaatactccaagtgagcagtctgggaggattttcggtctaccatttacagacagaaaatggagtggttcatgtgaaaagatgttactacggatataaagatggaattatgaaaagtgaagatgagggtgaatatcaaaccgattattggagatataccgatgatggatatctgatgttttctggaacttatttttcagaagaattgtatgtattaacattaagttctgcagaagagcatgtagcatttcgtatactgccattggatgcaaagtgtcgggaattaaatgaaaaatatcttttgccaataggatatgagttaaataatatgtttttagtggattggaatgaggatgattttggagaactgaatttctatgacatgtttgatttgttgtatccaaagttgcataatgaaaaatttccatatgtagcagatgataacttaggcataggtgcagtttatcatattcctaaaacagagtttgaaaatgtaattatggaatattttaatatcgacagtgataaattgcagaaaaaaactatttacgattatcaaactcaaacatacgaatataaaccaagaggattttatgagatagagtatccagaatatccatattccgaggtggttgggtatacggaacattcggatggaacgattacactcaatgttcatgtagtatatccgtgtgcaggagattctgatgtatatatgcatgatgttacggtcagacctttatctgatggtagagtacagtatgtatcaaattacattgtttcagaggaagaaaataacaacattacatggcatacgccacgcttaaccgaagatgaatggaatgatatatatggaggacagtaatggaagatataaaatggtttataaaaaagtttggaatcatttttgttatcctcttggtgatgattgtaagtgtaggaatcttttttgagaagaacgtgagaaaatcatcagcagaggaaacatgggaaaagccagtacagatatcagatatagagttttggcaggaggagtctgattacgagagggaaaatgaagataattcgccgtattggattattcctcagtcaaaaagtttactgtctgaagaagagagcaaaaatatccaaaatgaagcactaactgcggcagaactggtgaaggtggtatataaggatattgtaattatagatgatgtacctgcctatgcttctggaattgatggttttacaaatgaacagggagaacaggttataaaaatacttggaaaaagtggatatgtatgcgttaaagaaaatgtagagatgcaaaattatgataaattgcaaaatttctataaaagttatcttattggtcaggatacattgataacagtatttgtggttcaagctgatggattgcttggcgcacagacatttgtctatcgaaatgaaaagttgcaaagttactatgtaggtattcgatggagagagggcggagaaccagagatacttggaacttcggtaagtgatttgtcagaaattaaatttactgaaaaaggatattttatttatacgtttgaaaatccagttgcgcatgcaggattgagagaatattggagagtaaagttacttccagaaaaatgcagagaacttacagaaaaatatatagctggtcttagttatgtaaattataatatgctggttgtaaactgggatagcagcaatgtggaagatatattgatgccttgcatgtttgaggatatttatcgaatttatacagggaaaaatttaaaaacggacaatggggagattccagcagaagaatacgagaaaataatgactacatatttcccggtatccacggaacaactaagaaaatattgtaaatataacgaaaaaagtaatagctatgaatatgacatgatttctgccagcccatatccaccgtttggagaagtggttgattatacggaaaactctgatggaacgattactctgattgtagatggagtatgggcagattataattccgactgcgcatttacaaatcgaattgtggttcagccatttgaagatggaacttttagatatttagccaattctattgaacaaaaagaattggaattgccagtcatagcaagaatgaatccttaatgtgactgaatggaaaggacaatatttatgaaaaagtgcatttggttcattgtactgattagttgcctgttatgtggatgcataaggaaagataggacatcagacagtcagttgatggatagtagagatgttgattctacggaagaaaacgagaatgtaaaagaagatgttgcagaacagtgggaaaaaggttatgaccttccaatagatgagccggaaagaaaagaagcagaggatgagtgtaaaatgattctggaacttatttcagatatttatgctcaggcagataaaggagaggcagctaatacggttctggatgataagacaatttataaaatgcagaatcggataaaagaaaaagggtatccggttacaacgatgaaagcatatgcagcaatggaaaattataaaaaagtcgaagattttcttaaaaactgtcaggaagagaaagctggttcggttgtgctttacgagttgcattcagatggtggcattggcagagataaatttatttttgatggaaaggacatgtatttaataggtgcgtgtgctacatggaacaccaatgatacatatggattgtcctatatttcttatgcaaggataaaggagtggaaatatacggataaaggctggttttgttatgaattatgtgttccggaaccaccggaggttacagagattgttgacggaagctgtctggtaagaataaagccaatgacagaggaacagcgtgaaatgtctgaaaaatgcgtgcgtggtttgggatatcagggaaataacctcttatgttccaattgggatacagagcatatggaaaaactggattataacgggatatatgaatatctgtatgcaatgaaataccaggaaaagtttaattctgagaattatccaaatggaataccaaaagaggaatttgaaaatttaattatggagtatcttccggtgacgtcagagcagatacgggaatatgcagtatttgatgaggaaaaccaaacgtattattgggcgcgacttggatgctttaattatgcaccgactttctttggaacttctctgccggaggttatcgacatcaaagaaaatgaagatgggacaatcacattaacagttgaggcggtttgcgacatggtcatttgtgatgatgcagtcataacccatgaacttacggtaaagtttgcagaggacggcagctttcagtatttagggaatgaaattctgaatgacggaattatgcacataccagactaccaataccgaattaaagaatgatttgataatagttgtgttttgtggtaatcttacagatgtaagaaaaggaaggaggacacatgaagaaattaaaactagttggaatattggcagcagttgtattaataggcggtgtgatttcaattccgcttataaataaccacactgcttataaagtggaaaaggaattatgtgaaacaccactgccagagaaaacggaattgatagagtcaatatcacgggcagggaagctgacaggtaacggaaatggaatgcagtatttcggagcaattttaattcgaagtgatttgtctttggaagaattggatgcttactattcagggtacagaagtaatgagtgggaatatcttgtagatatccaagaaggacaagagattgaagtggtcgatcatagtacattgcaatttgcggagcagatagagagtaaaggatattacattgtgtattcgtggggagatgggaattctttgctgaaagagatagatattcgtggacactaaaaaggagcaagatgaattatgaaatatatttccaaaatcagtaaaatcagtagcttcatattttacatatttctattgtgccaattatggcatttatgccaatatggaaggatggtgtaaaaatgattataaagtctattatgaccgatgaagatagaaaagcattagagtatatgctttcgttagaatatgctatgccatatcaattacttaagacaaaaaataatagaaggaaaattatttatataatgacaccagtattatttttgttatcaatcggctgctattttgtaaagagttatccgatgttttatgtggacatggggatttctattattgcattgatttggattatttggtttcaatctaagggaaaaaaatttgaaaataatgtccatgaatttgtatggaataaatcaagatataacaaagtggaaattgatgttcagggaataaaattagaagataaaaagatctgtgaacttaaagaaatagatagagtctttttatacaaagattttttcttactcataacgaatgaaaagaagttacttgtactaaaaacagtaggtgtagagacagaagaacttattaagattattaaagaagctgatatcttatttgaaaaaagagaagaaccatttaatatttatgaatattgcaaaaagcagtaattaaaaaaaagaaaaaacgagtaaaagttaattctacagttaacctttactcgtttttgttatttctgtgatacccagatattcatgtctgacaagatagacatggttatttcagttgcgttgcctccggtagcatcgctgtctgcactaatgttggtggcaaaaaagtatgtattatctgcagtttcgatataaccgatgaaccatccgtttacatcctgtccattcacacggccggttccggtctttccgtagagtgttccggtatcggaagatgaaaggcggatggcatcttttactgcattgatattttcaggggcgaagccgaaactgttattctgcagcttggttaaaagttcgacctgttctattggagagatttccaaggaggattccatccaataagaggagaaatcaccactcatgttttcgttaccatatccaatttcttgaatatagctgtaaacgtcagaggctccaagctgttcatctactttctggaaataccagttcacggaggagttcattgcagactgtaaggtctgatctgcgttccatgcttcaaatggatagttttctccattccacgcaataaaggagttttcaggagtaatgatgccttcttccaatccgaacaaagcatcgtatatcttgtaggtggagtttggcgcaactcgcagggtagcatgatccttgttgtgtatactccatgcatcattttctaaatcgtataaaacaaagctgccttcgtattctccaaagtatgtagaaagatctatataggaaacattttctgaggaggaatcccattggtagtgaccgacatctgctgcgtaagtagaaataaaaggtgcgaatccaaggagaaggacagcagtcaacatgaatgcagtcataccttttactctttttataaatgtcggcttctcataagatgcaatgttgataattctccgtttcatctgcttcatgtttccaccaagaccggcggcaaacggaaatggagtaagtgaaatcttttccgcaaaattgatcagtgtattaccataatatgcataatcatcctcctcaagcatctttaaaacagaggtgtcacaggcaacctctctgtcattacgcatttctttcagagcataccagacaagaggattgaaccaatatattactccggcaaagttcattagatagttggcaatagcatctttgtgcttatagtgctgtagctcgtgtaacagcatgtatcgcatgtccgattcgttataatctgagatgagatgaatcggcagataaatacaaggtttcaaaagccccacaataatcggagatttcaaaaatgcagtactgtaaacatggatatttctgttaattcccatttctttcatacatagatgatatagttttcggacttccgggttctgaaggggaagtgcagattttttcaagttctgtaagcggatagaggatttgattaccaatataatcattgcaaggatgcctacaagccatatccctaataatatatatccggcaatggatggtgtctcactatttaccgaaagggcaaagtcattcatccagtctgcatttccggctggattgatcccaacagcttctcctatggcggttctggtgccagaagtaggagaacttttcaggctactgagccacgagaggatttgcggaaaactaattagacggaaggggataaaaggcactgctaaaagtccgagtaacagcaaccatagattatactgcatccggctggacaagttgtttctgaatacccatttggctatcaaaagaattccaacgataccgctgataaatacattgcataataaaaagcgtatcatgaaattagccatgttaatcgcctccttttttggaactcttggaaagaagggagcgaagtgtttcaatttctgtttcagacagtttatcgttttctatgtatgcagatagcatagaggtaatgtcaccattatagtagcgattcaagaaagaattactttcttgactaatatattcacactcttttactaacggtgtgtaaacaaaaacacgactttgtttttcataagtgagaacacccttggtcacaagacgcttaatgagcgtttggatagttttgggactccagtttgttgtttgtagtaatttttctgttatttcattggtgttaatgggggcatatttccatacaattttcataacttcaaattctgcttccgaaatttgtggtaaattcttcatgtaaatcactccttaaatcttacgcctgtaataaaaatagtatattctgtatttgttgaaatgtcaattttggaaaaatagttgactgtaaatcttacttatgtaataattgaactattacataagtaagatttgaggaggtggaaagttatggggaaaatgttgctgttgtcatttgaaaatagtgaagatgatgttattagcgagatattaagcatattagaaaataagcaaatgaaaatatgtgaaaataagaacataaaaaaatgcttagaatttcagggattaacaataaatgctgaaagacggttggcggtaaaaggaaacaaagaaatagaatttacttttacggaatttgaaattcttttactgttagcgcaaaatgctggaatggtatttagcaaggagaaaatatataatattgtttggaaagagccatattttggtgattataatattgtcatgagccatatccgcaacctgcgtggaaaaatagaagataatccaagtaaaccgatttacatacagactgtatggggagtagggtatcgcttcaataaaaatttaagcagtggtctgtaagttatagtccagatcactgcttatttttcttttttaacacccaagagatattcacaagatacatgaaaaaattctgccagagccactacttcataatccggtacaaagcgtgtcccttgttcaatgcgtaatacagtcaaatcactaaattcatatccggcaagctggagttgttcagctaatgctttttgtgatatgtgcttttcggttcgtaattcttttacacgttgtccaataaggtttttggaatttttttctttattccagtaaatcttcattcaaataccaactttctaaagatgaagtgctacatgattgattttacggaataatgttgataatatacttctaaagatgaaatataagaaaataaatttatttgatgtaatcttgggattgataatactgactgcaaaatgcaatacttatatggaaaggtggatacaaaatgaacgaagtatttgaaacagtagcagaggtattggaggagcttagaagcgaagcagaagaacgagagtattctgttcacacaaatgaatctgaaaatgcagataaagcattgaaaaaggcgaatcgggaatatgaaacagtgttggatgagctttcagcagagcacagagaattttttgaaaattatatggatatagtggatcacgctcattttcaagaagaacaaagagcctactatcaggggatggtagatgtaatgcagatatttgacggactggggattttaaaggaaagaaacaaagtgaaagaagtgcttatgcatatcaaaaaatagttcaaacagggtggatggcttatcaggaagctgaccaccctgttttttcttcagaataattcagaaataatccagaaaaaatcgaaatctttctgctattctgtttcatgggtcttatatgtacgaagataggcttctaccagtgcaagaatggtggttatctgatcgtttgtacattctgaaagataaaccaacagtctttggtaatccagattatcagttggagctgccggataaaagaacggatcagcagagatgtgtaaagctcgaatgagctgaccgagtttttcaaggcttggaacattaccatgattttcgatctctttgatatatcttgatgaaacaccggatttttcggataattcatcataagtcagcttttggtctaatctggctttcttcaggcgaaaacccatgtctttatcaattttcttagatttagccatgtcatgcacctccgtatatagtgtatagttcaccatttaaaaagaaaatgaactaataacgcactatataagaggggtataatgcacttaaataaaataagaaactttggatattgcatataaaaaaacgcagtattcaaaggttttttctcatgtttttatcctttgaatgtgtttgggagagttatgtattctgaaccgttgaaaggatatttttgtatttggaaaatattatcctgcccattgcgtggaaggacaggtaaataggtcacattttaagtaatgtggcaaattctacaattgaaagtgcattatatacactcgtaaaatgtggagaaaatttaatatcagctataaacagcgtcctgtgggtatgtgtccataagggcgttttttatatacagaaaaatttttctaaaaatttttcaatccacccgaacatctccccagtttcatttgggagatacaccggaagggaaaaaaggcaaaagccttggcattcggaacgggaggaggtgaactcgtatggggcaaccttcttctaaagatgaaatgactatccggcaccaatttgaccggttatgccagatggcattaaaaggcgaagctgtaaattattacaaacacatggactatcgcaggaaacacgaagttacattctctgaactgtcggaaaaggagctgagtaagttatttactatggatgagtatggaacagaatatcatcattttgaagtgcatggctatgacattgaagtaaaaaataccctgattgctgaagctttgaaggaacttacagaaagaaaaaggaatgttattttactttcatatttcatggaaatgagcgatgcggatattgcaagagaaatgaatctggttcgcagtaccattcatgaacacaggacacgctcacttgaaattttgaagaagatcatggaaggaatagcagatgaaaaagatgtataaaagcagaaatgaggaaaatttgttgcctttccatattataaaggcagcatcagagggcgatgtaagtgccatcaatacagtgttaaaacactatgagggatacataatcaaattgtctaccagaaagttatatgacgaaagcggacaggtgcattactgcattgatgaaacgctgcgccgcagattggaaaccaagctgattacaaaaatattggcttttgaagttgcatagcatccggtcagaaaattccctttctattcattgattggaaatgatgcagcgttgtaccttgacaactgaatattgatttgcatacaggacgtgaggatatgtggagccactaggtaggttcgcaaagatgtacctgctcttttttgggtgaacgtgaagaaatgttgaaacattacattgaagcaaaggtatggagcgagaaaaatctgacaaaatgtgtggcagtaacacagggcgatgaagcatatctgtaataatgatacttccggattgtaaagaaatttgcagtccggtcaatttgaatgacggtgcaagaccgatgtgggcagagtaatgacctgccacctgtattgcatttttatctgccgatgagagcctgcaatggtgtgtgggttgtcattggcagataaaatgcgtgctaagataggaggtggatattatcgagaagaaaagattattgagatatagtatgcagctatctatgttgcgacaactcttaaataagaaactgataaatgaatttgaatatgagaaaataaagaaacgtttgatgaatgattataacattatatctgatattacagcttgacttgttgagtgtattgcaatataataaatatgaacactacggagggaatacaaaaaggagggcgtatggaagttgaagttattaaggcgaacaatccttttgatgagacggcaaaagtaagaaagattgaccgcctgagagtagctgcatattgccgtgttagtacagatgatgaagatcagattaagagctataattcgatggtaaagtattacacggagctcattaagaataataatcaatggatttttgcaggagtatatgcagataaagctattactggaacaaaagttgataaaagagaagattttcaacgtttgatacaagattgtatggacggaaaaatagacatggttattgcaaaaagccttccacgtttcgccagaaatacgttagatacattaaaatatgtaaggatgttgaaggaaaaaggcatcgctgtttattttgaagtggaaaaaataaatactatgaaggatggcgaattcctgatgacgatattaagttccgtggcacaacaagaggtagaaaatacttcagcgtatgtgaaaaagggcttgaagatgaaaatgaaacgtggtgagttggttggatttcaaggctgtcttggctatgattatgatgttgcgaccaaatcactttctatcaatgaagaaggtgcaaaaactgttagatatatttttgaccggtatgtttcaggtgcaggaagtactatgatagcaagagagttaaatgagcaggggataacgaccataaaaggaaatccatggacaacatcaagtgttatgggaattatcaataatgagaaatataagggtgacattttactcggaaaaacttttacggttgatcctatatcaaagagaagattggaaaatcttggagaggaagatagattttacataagagatcatcatcaacctatagtttcagaagaaacttttgcaagggcacaggaaatcagagagcgaagaaatggtggcagaaaatctcctacaccgggaaaaagagaaaaatatagtcggcagtatgcttttagctgtatgctggaatgtggattctgtggttcaagcctttccagacgaagatggcatagtaattcaaaatataagaaaacaatatggcaatgtgtaacatcaacaaaaagtggaaagcgatattgtccagatagtaagggaatcccagaacaagtgatagaggaagcatttgttgaatcttataaaatgctatgttccgataacaaagatatactagaggaatttatttctagggtagagaaaacactgagtgaagatactgcaagagataagctgatgaaatatcagaaaagtgcggataatcttcaatcaaaaagaaaaactcttttggagaagtatttagaaggagttgtttcacaggatatttatgaggaaactgatgtaggatatgagagaaaattatccaatattagggcaaatatcgaaatgttggaacaacaaatggaagatgaggtatccctgaagcgacgagtggaggatttcaaaaaggcattgtctcaaaatgaagtgctgcaggagtttgacagaggtatttttgaaagtattattgaaaaagtcatagttggtggctatgatgaagatggcaacaaagatccctataaaattactttcatatataaaacaggatttagaaacgaggtcagaaacgcaaaggagcgttttgacaaagcaaagagtgtaggtgataaggcgaaagaattgtgttcccatatcgcagacgaggtaaaagatgtgtgttcctatgttagtgacaacacatgtggagactgttgtcaaattatccctcaaaaaagatacacctaagattgaggttacaatggagcctgatgaagagagtaattatacaccacaagaaaaggctacttattcaaagattaaggaatatgtgaaggaaaagtacggtgtgaatgtgcatacttcttatattgcacaggtaaagcggatgtgtggtctggacatgggcgagaactacaataagtctaagaaagggaatcctgaggtaaagcagtgcccgcaggagaaggtggagtatattaaggatgcgttgaggcattttaaattgatttgaaaggatgaaaagacattctaggtaaatggataaaatgatagataagatttttgaaacagtaaagaaatcattaaatggagataagccgttcttaaggaaattaagaatacttagatacatagtgtgcataataatattgtttattgtattttgcagttcatattggaatgtattggaatatatagatttgccatgtgctccattattggctgaaaaatatagaatgttattgcatataattggaatagttggttttgtaatctggatagtgtacaatttgttatttcaaaatctgtataaaatttatgatgagaaatatcatatgaaattattatatatagacattttacttgatttcctttttaccgtaatttttttactatatgcaataaatttagggatagagtatgcaaatggattagagacacgaataaaagtacaagcttttattgctactgcatatttaatctatggagcattgagtacatcatatacgttgcatcgaattagatatgagcgtaatcagcctgttaaatataccggatattgtgacaacgaaggaaaggctataccggttgaagcaagagttttttataaaggtaaaggatacaaaattgttgagtttcaagaaatatatagactgttaccatttgatgagaagataataacttctggattgatgaaacttgaagatgctgcgagtgatggagaagggaaattgtttatatacaaataaattgtttaaaggaaggttgaaatataccttctttttttataccgtgtgtccagcgaagctggaccacacttgccggtgaaagtccggtcacggtaatcgccagtgagccgtgtagctaaactcggtgcgttgtagtaatacagggtgctaagcgagtggataaagtaacctcgacaagaggagcgagcaatcatgcagaccgtaacattaagtgaattctgccgtatcgttaaaaaggtctctgataggagagcaaagagaagttgagccttgggtatatgggcgaaaaccatggaacgtgtgaagaaactggaaagcagcacggaagaatctttcggtatagaggaagcggtatgtatgaaaagtgtggttcggaactggagagaccctacccatcaccaaaaggtaaaaagaaagcgtataagctggtcatatgtcaagatttagtacaagttaaaatgagaaacttttcccattttaacccgccagaagctcagcctcagtgtgtgttcttttatacaatcgttcgaattcatttggtgacatatagttacaatggctatgaattcgtttcgtattgtagaaagcttccagatattcgaaaatcaagcggtatgcctgcttgtaatcgtgaattttaaagcggttgagccattcacgtttgataatcgaatggaaggattcaatgcaggcattatcccacggaaatgctttctttgagtaactacgctgcatattttctgttacttttttatattccgtcgcaacgtactgactgccacgatcagagtgaatgatcaatggctggtcgatatttcggcgagctttggctttgtttatcgtatcaatcacgcaggatacttccagtgtttttgaaagtgtccatgctatgatttttctggaaaataaatccataatactggtcagatagacaaatccgtctattgtccagatgtaggtgatatccgaacaccagacggcattcgggcggtcaggattaaactgctcatcgaggatattttgtaattcagtgctgaaatcagaatcttttgtggtaattgtccatggcttgctccactgggcacggattcccatttgacgcatgtatgtaccaacagttctttccgaaatgacttcaccggttttccgcaattctacagtgattttcggagcaccgtagttctgcttggaatcatcatatatatcctgtatttttgcttttacagattcacggcgtttttctgtatcagaaggcacgcggtggagccatgcacgatatcctgaacgtgagacacctaaaaatttcaacattccggagacggaaaaccggcgtccagccttttgggcagcttccgtcttctcagacacttcgagataaatggcttccgtcattttcccagaatgttgattgctttttttaatacatcaagtgcatcttgtgcatcacgtaattcacgtctgagacgggcgatttccttctgttcatcggatgcgtaattaccagaaccccgaacaggaatatcaccggattcacggaagtctttcagccactttgttagtgtgctgtatccgatgccaagattttctgcacatccacgtactccgagatctttatgatcttgatagtactggattgcatcaagtttaaattgtttgtcatgttgctttgccatatgagatcctccttcagcatgtttctattgtaccatgcttatgtgtatttggaatttctcattttggcttgtactatttatattctagcaccaagcttggcgaaatcgtatttctgatgggagggagtcggagaggaacatagtaccgataatgactgtgcaagaaaacgcagtttatgggaaggttccttacttcattcaagtttgtagagagggtaagagtgagagaatgtcatgcagactaataactcaaaagaaaaagttcgacaacttcaaaacaaactatatctgacagccaagaaatgtgacagccgaagatttcatgcactgtacgataaggtgtatcgggatgatgtacttttcgaggcatggaaacgggtaaaagctaacaaaggttccagtggtgtagatggtatcagaatcgaagacattgaagcgatgggaattgaaaaatacctgtcagaaatcaaatcggaactgatggatggaaagtacaaaccatccccagtaaagcgagttatgataccaaaaccagacggaagtgaaagacctcttggaataccaacagtcaaggacagaattgtgcaaatggctaccgttatgttggaacgactgtcgctaaaataatgaaagaagaaaatttatgtttggaagaatatttagaaaaatataaataaaaacaaaagaaaatctaactttttttatagtaggattgttatattatttagaaaacagagggaggcaaatttgcgaatggaatacaaaactgattctttgttagtacatctagcaagagcaggagatgaagatgcgtgtgaaaaactggtcaaaaaatattactcaagtatatatcaatattgtttgctacatatcaatgatccctatgaggcagaggatttgacacaagaagtgtttacacgtttcttttccaatttatatagatataaagaatatggaaaagttaagaattatctttatacaattgccggaaatacagttaaaaattattacaaaaagaaaaaagatattccatcagaggaactgctaaaatcagaggactgtagtaaaaatcatgtagaagagctaggagtccgattaactattgaacaggcagtgagaaagttaccggaagaaattagagaaacggcagttttatatttttttcaggaattgaagcaaagagaaattgcagaattacttcatatcaaactttctcttgtaaaatatcgaattggaagagcaaaagaacttttaatgaaagagttggaggtgaaaaaagatgaagaattataaacaacaaataaaggaatataaagaggagattgaagaaaagtatgtaagggctgaagcagagaacaaaacagtaaaagcatgtcagaatattttgtcagagtcggttttatcgaaacaatcgcatagaacatcttattttgaatttttgtatgagcagacaaaattcataaaaaaaagatggtggattttacaaggttgtgttcttatgtatctatggatatggttgagtaattatacgtcagacataaaagatatgatgaggattatgggaatatctgccacaatatttgtggttctgattgtcccggaaatttggaaaaacagaagaaatggtgcgattgaaattgagcaggcgtcttattacacactgcgtcagatttgtacagcaagaatgttaatgtttggagtagtggatctggtgatcattatggtgtttttggcaattacatatcaaacaacaatactctcgttaagtgatttggtggttaattttttgcttccggtaaatgtttcatgttgtatatgttttcgtgtattgtacagcagatgggaaaaatcagaatatatagcagtgctttcttgtctggtatgggttggtttatggatgatgattgttgcaaatgatgttatttatcagaaaattgtaactccggtatgggtggctatgctgatattgacttttgtatattttattttttgtgttcagaagtcattgctatttgatgaaaaaattttggagcaatctggtgatatgtcaagatgatttttgaaaagatttcgatatgtttttcctccatatcactgtcctttatgtgcagcattacccgtctgatttcttccatcagcttcattctgtttgatgtctcaaagacacacatcaaatttgtttcttctaccgtaaatggattattcatattcctatatttcctccctgttcgtctttttagttttatcctgctcttttgcatctttattcttcccctgtgccacttccgtctgcttggctgccagacgctcctttaaggaagtacgagcctgcggcttttccacctgttctttcttttcttcctcacgattgaatttctccacgccattgttgagcctgtcatcaatcatgttataattctgctcctccagctcctcgatcttggcaagcggcttatattctgccagcttagcaatcagcttttttgcctgtctttcgctgtcctcgtcaattccctcatcaagagatgtctgcaaaaaaatctgtaatggcttcacattaccgctttttatatcatttgaacctgtgcttccctgtccggtaccgagtctctatattcaaaagtgtcaatatcataggataactggtcaagttctgtcgcaatcgtctgtatctttgctttctttgtctccctgtcattaacctctttatccggatatgctgcaatcagttttttaagggcatcctgcactatgggagtatcccgaagctctggtgtgtaattcagaaaatccacatctatgcaattttctctgacaatatctgcttcctcatcttcccattcttctgtaccatcaatgtgcatattgacaccaatcgaaggtattccatgcatatcttactcatctgcaagcacttcttttaatttttcatagtagaatttctcatgtgcttcgctaataaagcgaatgttctctttcttgttacttactgctcctaacgctgtgttgttcatagtgaacctccttctgaaattgaattgaaaaaggcactcctaatggaatgccctaatataaaaaatagggacacacatttttctaagcgcatccacttctttatgccactcattatccgtatttgcaaagtccgtaacctctgctcctttttcgtgattatcaaaatcaaatacaataaatctgcatgtaccatttgacaataaaggatatacaccgattacatctgatccatcttcttttgtgcctaacaaatgagcaattatttttttacatccagacttatccatttggtattttcacattcatcacaaaacaccttctctttacgttgtttagggcaaagccggtcattccaacgattcgcacactgtggaaaataacccccgttctttccccgtctggcatatacatcttctcttccccaaaacatcgaaaagaaacgtattgccattttctctgtaatatatggcggatttacaatacgattcccttgatccaggtcatattcttctgcactttctattttttcttcaaaaggattcacctcttcatagtaaatgcctgctttcttcaatttatcttttaatatcttgttctcatattcaagcaacctaaccatctttctcaatgaatctgcatcatatgcttctatgttcaaaccttccacctacaattcttattatctcgtaacataacttccattcaatgtcccaactttattttagtatttgttccaaatattttcagtacttatttttcttattgacgcacttctctgtcaatcgtataattaatacacaaaaaaacgaaaagaggaggtgttcgtatggctacttcaagtattactcataattttgtcatatccaatccaaatagcgtgaaacattttatcgcagcgattgatgaagctgaccgtgaccgcacaccaaagcagacacttcccggacgtcagttgacaaacccacaagaaatcttagctttaatgtcaaagaggaaaaaacaaactcttaaatattaaaattcttcaataaaaaatcctctaaaacaataggtatttcactatctcttagaggatatttctttactttaaatgatatttggtaatacttttccagttttccgagaaacccattttattcaataattcaacttcacttatatgctctacttctctgtttactcggtcaatctcttttatgagctttcttttaaattccagaaaatcttttccaggtaatagatatctaaaagcaatcaccacagcaaacaaatcttgttttcctttttcgtactgattaccgctctgtggtaatgaaagttttttatgaagcggtgtatccgcaatagcatctactgttctgtatgtaaacagtcgttccccatgggcacatacattcctatacttagtgagaacagatagaaactgttccatctgatgctgattcaaaggttcaaaattttttgatacttttgattttaaggactgcggaaacactcggaacatttttgataagtttccaaacgtaagtacatttgccaaaacccataatggaatttcaccatatgtcttgcggtaatagttgatatatgtataatctgtggtcgttgttgcccgtttcaaggtcgctatcaactttacgattgttgcatgatttctttttgtattattataattattagcatccaggtactgcttctgctctgctccatacatttcagtaaaatagtatgacatcaaagaacgcatctgtcgctcaatctgcagtaaatatttaaagaacaactctctaagctctgcatcaaacttatacagactgactatttcttcaaaacttgttcctgctttatatttttttgtgtttgatattctaaaaagatgtttatatcctcccataagaggaaaatatcctatttggcgtaacatctcttccgcatattctctgtcttttatttttattcccttttcatcactgatccaggaaacctggtcactaaaagaagagaattttttcggtgtctgcatctcatttctccttaaaacaaaagagggagagacccgcaggctctcccccgcctgtaggcttctcaagtttctacagaacgatcactgagcttagtatacgtcattttaaatgtcctgtcaatacgccaaaacattcttagccatacccgctcagaagtattctatgctgttttttcttccttattctgtttttcttcctccaactcccggaggacttcttcgccgtacttatcaatcatccgtaccagaaaatcaatgcaccgctcaaattcaatattctgttgcataagctcctcccgtcattgttttgatctgagcttattttacagaacctgctggaaaaccacattgaatagaaattgattgtaaattgacacaatcactttaaaaatatccgcattttcttgaatcgaatatacgttcgtgtatatgatggatatacttaatcttaactacgaaaggggaatttctattgaatcgatgcgatttttcttctattagcacttgcttaaaaaatcatatcagcgaaagtaatcaaatgagtcagcctgattttttatacgaattatttgaagattttatggatgatccgacaaatcaggatttttcaatggacaacggtctggtttgccgctggatgactggtcaggctaaaatcagtcctaaaatatccgcttactattccaagccatccaatcaggaaaaattagctcatactatccaccagaatcttcttccactgatgtctgactgtaatatggctatacctcagattgccaattatgcaatgttcctgacagaacagcaggaacccgaaagaggaatctccgaattgcaaaaattatccggcatcatcaaggaataccattccgatcactgtctggattatgccaaagtacaggaaacccttggaaccatttatctgatgaccgccaatctttcacacgccaaaacacatttttaaaaagctttcaaaatatatgaaaagatctgggctgatgaaccagaaatgattgaagcaaaatatcaggaaattcaggagttatatccacagattggattttgcattgaaaaaaatctatccggtcttttaacaaaataagcataatttacggcgggcaacttgcccgccgttatattcaactattcgtcaaataaatatacgcatcttccaaagtgatatcattatccgggacacaattctcatttggctttcctttgcttaatactttcatatgaattccattttctacatactgcttagatgatatagaataattggcttctaacaaacgggcttcttctgcattttgtaccgtacaattccaaacacagccctttgcattttccaacaatccactcacgcttccggaatataaaaaattcccttttttcataatggcaagctgtgtacaggttgctgctaaatcttctactacatgagtggaaaacagcacagttctatcctttgaaaaatcaaccagaagattgcggatcctgattctttcttccggatctaacccagttgttggttcatcaataatcaaaaaatccggattattaagaagtgcctgtatgagtccgacacgtctcttcataccaccagataattgccgcatttttttattctgatgctctgtaagagaagtcttttccagataataggtaattctttgttcgaggtcatttctggctactcctgacagtccccccatatatacaagacattctttcaccgtaagattcggatataagtcgatttcctgtggaagataaccaatctttttctgtattttctcataatttccctcgttatacagaattccatcaagggaaaccattccttccgtttgttttaaaacagttgtaagaaccctcatcaaagtggtttttccggcaccattctcacccaaaagtccgtaaattcccttaggtatttcaagagatgccttatttactgcaactacaccatttttaaatctaactgttaaatcatttattctaatactcataatctatcctcttttctttaaagtcattggtaatactgcaaataaaaacagccccgctataaaagacacaagcgttccataaatccaactctcggacattaattgagtaggttcacaaaagctgaaagaaaacaatcccagatttccgaaaaatgaacttcccgcttttgatataagtccaatgacaattccaaataaacatccaatacctgcccacatatttcgaagcaatgtacacaaaatcacagagcatatactccaaagccagatagttccaaacattgcaatgaaatataaaagaaatatctgaatacccgaaatgccttcgtttacactgcccggtttttgccagtaaaacaaaacatatccaacacaagaaagtattaataaatataatatttgaacgcccactctctgcgatattacttttaactgctttttttgatcatacaaatgaaatacatcggcacgcttactttttacttccatcaaatatgtgtcactacaaaaaataattgttaaaaatgctattggagactgaattgctgaaccgatttcttcatagtatataatcggatgaataacacacaatatcagtataaatgcacatgaataaaaaatcttatataacgacaggcagttttttagttccgttttcaatgaaccctcctccttttccagattgtaacagaaatacatactaatataactgatgaaattacaagaataatctgatttatgtttgacattttagctgcatgtgtttcaaaaaacctgccagggaatcgcaccataatagagaacggtctcatataataaatatcattcttcatggtcagcatatttgaatatataatgtgtaaaaacaagattggtgctgccggaagcggatttttaaatattaatgctgtaattgtatagacacaacatatcatcaaaagattcggaacaatatagatcagagaattcacgcaaaaatcaattggtgttactggaaagcccgattctaaagacgttttcaaacacagcataaagaatataacattcaaaatcactaatactcccagcatactaatgaatccgcttattactttcccacatatatattggattgccgtaacaggctttgtatgtaataattcataggtactttttcgtgtatcctgaataaataaaaatgatagcaagactgttgcaaaaaaggccatatgcaatcctgcaaaatccgtaaattttttggcaaagtaccaggaaaaagaatgttcggataatttccgctcgatataatgattgatttcttctgctgtccccttatgaatttcaaggtcctcataagcatatattgcattataatagccatattgggattccaaaaactcagaagcagtctttacatccatattctgaatttctttcattacatgatctgcttcctgcctgctaaatccaaaaccatttttggaggtgtccattaacgtctctttgatcgtatcttcccactcccttcttctttctttatcatcagatgtgggaatgtacccatccatgacatcagcatcttccaatgctacgtcattttgtgtgatctgttcattctgtttgatataatgaatttgcaaatacgatgacagacattgatacatactggcaactataataatcaagccaatccacaaaacagggttctttaaataatcaagtatacttctttttatgattgttttcattgtatctcttcctttctttatttctttaacaacatcatacaaatcaattctcaataaattcacaacaaaaaagactaaaaccactttatttgttgtttcagccttataaagtatttttattcagctttgaaaagagcttctacatgagcaccgccttgtctggcattatatattttcaaatttcctccatgcttttcacagaaaatacgagaaatatacataccaaggccaaaatgctttaaatcatcttgtggattcttatgataaaatggctctgttactttttcctcagtatccacaaatcctattccatcatcttcaacagaaattataagaaaaccatcctttttctttatctgcaaagcaatacttttttgtgcatatcgaaccgcattttccagtaagttgtctgtcacttccatgacaagttcctcatccactttcacaatgttttgttcctgcactctttctaccttacataatttactttccttcttggacagcatggcagcttctgcctcaatcttttttgccagttccgataactctatctctgagcattgcagttccctctgttctaaatgggacatttttctcatgttttccgtgaaatgctctatacggtcaatctgatacatgcctgtttgtaagatatcaataacatcctctgtttttatactctcggcagaaacaaactctaagagcatttcctgatacccacgcaatatggaaagtggagaacgtatatcatgtgcaattgcattccgcaaagccttctcgtcatcaatcattcgccacatctttctgttgttatctgctaaatcacttcgcatcatttcaaattctttacacaaagttcccatctcatctttattttcataggacacatgaaaatccagttcattatctgcaatcatttgtgaggcatcttttagttcctgtagaggtgtctttaacttatttttataaaaaaagaataccgcaacaacactcccaacaatcgaaaaaatcagtaccgaatatgtttccataaagtcacacatttccgaaagatgatagtccaaacgattcatctgcgattgattaggtcttgatatctcaatctcgtatttctttccatattgctgaaacacgtccgtataatctgcataatcaatatatttttcccatattttattctgcatatttcctgcaaaatgaactgtaaatccagataacagaaatgctgccgttaagctgatcacaaaataaagcagaattgtttttttcagtgacaagtttcttattttttccatcggtatccaatcccccatacagtttctatgtattctttttctgaataatccgctatttttttccttatacgccgtactaattccgttatcgttctactgtccccttccgcatcatatccacagacttgtgcatatatacgttctttatcaaacacctgccctggatgcatggataagaattcaataatctgatattcaatttttgtgaactccatcctgtgtccagctatagctactattttttcagaataatcaatcagcatttcatccatgaaacggtattccgttttttgttgatgcctttcttctctctttatgtttgtgacaatccttgcttccaactcccgaagactaaatggtttcgtaatataatcatccccacctgaaagcaacccattaattttatcatcttcgtcaactcttgctgtcagaaataaaattggacataacactttactgcgtatcagacgacatacttcaatcccatccatgcgtggcatattgatatccaacaaaataatatccggtttcatttttattttatttaatgcttccattccatctgtagccgtaatggtttcatattgtttcatattaaaataactacaaagcattttcaccaattctttatcatcatcgacaactaaaatcttgtatttcatccaaaccacctccagtatccatattatacgataaaaaacaatgaaatcacaacaagagtacatgaagaacgtaagcacaatatatcttttttctcaattccagttcaatttcccctcaatccctttcctctttgctttttatatacttatctcacagcaaaacagtaccacaccggtacgatctgctgaatcaatcaatgcgaaaatagaggtgttttttatgcaggtgggagagcaaagacctcctgtggctgattgctttcacagaaggtcttatttgtttatgctgtcacattttcaaatttcagatatggttgtctttctcacacaccagcctttcataatccagaaatccacggatatacatttcttttgccgcaataccttccatggcatttttcgctgaaataattctgtccaatgcctgccacatcttctgtccgtcatctctgaggactggttccagtatttctatgtaatgatgaatttctgcttccagagaaaacatctctggatcggattcaagaaatctttccagttcccgctagtattcttcataataactttcaatcaattctcttctcatatctggaatcccccttatacataaatcagttcctgtttgatgatttcagcagcccggttgcggatattgttgcagtggcgtacccattccataggattctgtctcttcagtttctcagtaacttcctccgcacttcgcatttgagcttcaatcagctcaaagtgttcctgtgactgttcattcagatctgccagatagctgtccagtctggcggtcagaagaagatatgtataagttccagatttatgtgctttcagatattccttacgaagcattccccaacagccaatcggtctggcttcctccggatagtcaagattcggtaaataatagtctcccacttttgtgtattcgattttcatggtgtctcctttcgctttgcatgaaattgtcatgttatctacgtaggatgtgcatttttcctttaaaatcttttcacatagaagacactaagtttttgataccctgtgattttgcttgtgtgtggtaaagaagcaatagaagtgtaaatttttttgccgttcctatccggcacttgcgcaaggtgtcggataggtcgggcattattcgtcgggaagttctaccttgccgacaaagctgtaataaatatcaatgtcctgtctgcgtgtgccgttctcgtcatagctgcactcatggacaacgattttttcaataaactcccgcaacagggtgtgggtcaattcctcaaagctggtgtacttgcggacaactttcataaacttttccgcattaaccgtggcttcctgtgcctttgccagttccgcttgcagttcagcggcacggctcttgacctgtttctgttcggcttcatagtctgcggaaagttccgcaaagcgttcatcagaaatacgcccagtcacactgtcctcataaagccgcttgaagatagcggacagctccgcaatccgcttttcggctgcgtccagttcctttcgcttggcagcgttgcggcgtttgccgccgtcctcgttctgctcgatcagcagcttcataaactgcttttcatgcttggctgcatagcttgtcactttccgcagattggcggtcacacccgcagtcaaaaggtcggtgcggataaaatgtgcggtgcaatcgtgggtacgcttcttgtagttgccgcagatgtagcaatcctgttttcgggttttgttctcgtatctctgctgatagaggacgctcccgcaatcggcgcagaacagcaagccggagaacagaccgacttcatcatagcggtttggacgcttgcgctgcttgcgtaattcctgcacacgctcccatgtggcaaggtcaatgattggctcatgggtattctcgaaaatgacctgtttttcttcgggattttccacgcttgatttgaccttgtaggacactttctcggtcttgaagtttaccgtatgccccagatattccttgcgttcaaggatatggacaatcgtgttggtcgcccacttgtagggataatcggggtagtaacggcgtgtgctgcctgtcctgcggtattccaatgtacccggtgttgggatttgctgctcggtcaatacacgggcgattttggtcggaccgttcccggcaaggcacaaactgaaaatctgcttgacgaccggggcagcttcttcgtccacgataaagcgtccgtcctcacctttgagatagccatagaccggctgacttgtgataggcttgccactcatgcctttgctgcggaaaactgccttgattttcttgctcgtatctctcaccatccattcgttgaagatattacgcagaggggcaaaatcattgtcgccctgtgcgctgtccactccatcgttgatagcgataaagcgaacgcccctttgtgggaaaatcatgtccgtatacattcccacttggagatagtttcgccctaatctcgacatatccttgacaatgaccgttccgactttcccggcttcaatatccgcaagcatggcttgaaaaccgggtctttggaagttcgcaccggagtacccatcgtccgtgtaccattggagattggtaaagccgttctgttttgcatagctttccaaaatacgcttttggttggagatggaattactctcgccctgcaattcatcttcatgggataatctcggataaagggcggtaatgaggttttgggttgtctgtctaatcatggtttcctccatttccgacagccagccccgctattccgtaaggaaattatatcacacggggcggctgcctgtatagctggtaaatgtgaattttgcttctttatcgcccgtcattatgacgattttttggaattaggcttgtcatgcagtataacttggcttgtgtgtagctgcggtttccgcttcaagcactttcatcatcttgtcggctgcggtggctgtggtatctttcttgaaaaagccggacacaacaagcacggtgttacccatgcggatctccgtcacgcagtccggacggcggtcggtgcggtcattgttattctgtttgttttctgtcataggcaactccttttacttcaacagttcttttagtccattgagcttggcttgtgccgtttcctttcggaagttctcgcctgtaaagaggataggcagacacatttcaagcattcggtcatagatacgggcgtgggcggtgtcctgtggattttgcagttccgtaaggcttagattggtggtgacaatcagcggcttgcggctgcggtatcggctgtcaattacattgtagacctgttccaaaccgtactccgtgccacgctccattccaaaatcatcaagtatcagcagaggaaaacggcaaagacgctcgatatactcgtttcgcccctcaaagctggcggtcaaatcattcaatatcgcagaaaagtttgtcatgcggacggagatttcctgttccataagggcattggcaatgcacccggcaaaatagctttttcctgtgcctaccttgccccacaagagcagaccatagttgttttctctcatctgctcccaatgctccacatataaatgtgccttgctcatctgtgggcatttgccgttgtcatgtgcaaaagtccattcctgcatggtgaggtcggtaaagccccggcgtttcagttccataacggtgtcaaggtgtcgcctgcgttcctcggcagcttcacgctccaaacgcttttcccgttggcagtcacattctgtcgggtgtttgtcatgccccaaccatgcaatggtttctttaggaaagtaggcttctttcgccgtgcggcacttgccgcagtaaagaagaccatcctcgcctgtgtagtcctccgggtcagcggtggcagtcatcatattcaaaacggtatcggtaaaaagttcactcataaactctcgccctccttaaaggtgtaatcgggtatgccttttttcggtggtttcctggcttcgtcctcctgcgcccacttgtatatcgtggctgcatggctacggtatttcgttcctttggacgctatatgggtagataggcggtcaatataatactcccacttgtcgggcagttccgctttcagctcgtcaagctccgtattggaaagaaatacattgttgtatctgccatagcagcgggcgggggcttgtcccgtttctaaatctctctctttttctatctctatatctatctctttctttatctctatctctggtggacgattgtcggacaaatgtccgccgtttgtccggggcggtggcaaagccttgtttgcaagccttgccgcccgttttcgttccgcttcggtagaggattgacctatcatcagttcaatatcggtcatgtagagcaaaccgccgtgtagctgctccacaagccccaactgctggaaaatccctaatgcccgttctactgtgcctacctgctgtcgggtaagggtggcgatcatctgtgctgtgtaagggatattctcgtcaagctgcaacttgccgccgtttttcagcgattttaagtacagcttcaaaagaatgttggaatagagaataccgtccggcatactctccaacagcacgatagcgtcatcatcaaaatagctttctttcagtttgaggtaataatatttgcggttatctgccataggcggtgtcctcctttggtttccaacgcttggagtaataccgggggcagaggataatcacggctcgaaaactctgcttgcaatcgtaggtgcaactccggcaaaggtcgttataggtaattcggtttcggtggttgaggaaaaagctccattcaagccgccgtttattgcccatgcgtggcattggtacgctcctttctgccgtttccgtaggtgtcacggatagggcgtgaaaactgtatcttctcggtatcattttcggggattttttgccctgtacgccctgttttgaggttgggtagtattgcggataggggtaagggcatatccctgtttttgtttggtttcggtatcatttcggggcggtttttaacgctcctgttcatgctttttctgtcggctcggctcgccgtggtgcatttgggaaagattgcttttcatggtctgcaactctctgacacgctctttatttgcccggtactcgttgtaaagggcgtttttctcggcggtaagctgctcgatttcagcctgcaacgatttataggtgggcagcttggtaatgcctttttgccgaaaatatcttatggctgcgtctgctatgataaagtcgctttcatgcttttcccggtaggctttgcgtgccttatcggttttctgctttttcaatccgtcccgcacatctcttgtcttgacataggcaagcacctgtttctgcaagtcctttttctcacggatagccgtttcaatgggcttcagcttggcggtgctgctgtgtaaatccgcattggcagacacaagggctgcgtccagttcctccggggtaaagccgtattgttccatagcggcaacggtagccgccatctgtttgaggttatggacagccgcccaacggtcatagccgataccttttccctcggctcgcttcgccgcacggtcaatcattctctgaatgttgcctgtcggggcgattttctgcgtttttcctcgctctgtgcggtttgtttcagcggtatggtattcgggtatgggtgcggtcttttcggcggctctttgggcgttctgctccaaaagggcaagaacggcggcacggtcaaaatcatctcccagttttcgggcggtaatgggttttgtcctgtctggggtaaggtaggacaatcgccctcggctctctttgacggatattccatgctgtaagaggatttcggaaaactcatcaaaggtggtagccctatcaagggcgtttcgtatggtctgccgcaattttgccttgtcggtttcaaactcggtctgctttacaggctgtccggcggcaagagcagcggcattttctttatcaagggcaagctgccctttcttctgtgcccaatactcacgctcggtaatgcggtttttactgccgtggagcaggtcaatctgatagagattttcccggtggcacatctccatgacttcggctttgaagtattccatagcggcgtccgtacatcggtgtttgcacccggcacgggtgtctgccggtctgtccatgtagggcaataggggtacttcttcaatccgcagggaattgataacgatgtgaacatgaatattgccgctgtggttgtgtccgtccgggtgggtgcagacaatggcttggtgtccggggaaatgttcggcacaaaatttctcgcccaatgcttgcgccctgtctacggtcaatccgttgtccgctgcgtcccatgggtcaaaggaaatgatatagtggtggcttttcacatcttcccgtttttggtttttgccgtatcggagatttgcccgcatacaggcaacggcaaaatcttcctcgccgcagttcatagtggctattcggtagtcctcccggagtatgagccgcccggcttcgtcaagggcgggtttcatggtaaactcgtcatgctcaaaggttagatattgctcggctgcaccgtagtccgcatttttagagctgatatgcttgaatgttgccaacagcgtcacctacctttcgcaagacttcaaacttcaaggcggcaaggtcggaaatggcggctctcacctcaacggacagggcattatagggcgttccgtattcattgagagaatgtgcgatctgattgaggttgccaccgatttttccgtattctgcggtcagcttgccaacagcggacagcagttcatcattgaccggggacacggtaacaatggggcgaatggtcgcccttgttatggcttgccggataaactcggcttggctcatgtcatagttctttagccgttctgtgaagtcagcatattcttcctcggtcatgcgtgtcttgacaacacggcttcggtggggcgtattgtatcgctttcctatgggtatcaactcctttcacttaccgccgttttgagggcgatttttaaagtatttttcggtgggattctcaagcggcgaatgccgcatagcagggtttggggaaggcactccccaacaagatttaccaaaggggcaaaaccgcagatatgcggattttggcaccgtggtagaatcttgctctaagaaactgccgctttcctctgcgactctggtttgcggatatactggcttgcttcaccaatatagcgattacagcggcgtgttctgcccgccgctcaccactacaacggtgaaaagggtgcgttttggcaaacgcagcagaaattttttattttccctgtctgctccttacaacaatccggcggtgtggtttgccaaagatttttgaaaatgggcgcaaaaaaagcagcaaatctttttcggatttactgctttgtgtgccgctgcagggcggcgagatattcagtttttatgttatcggtcaagccggaacttgaataggctttcaatcagctttgttctgatgtaatcctccatatcagagttataatagccgttcattttggagaaatagcggatatatccggcgtaacggtcaaggacggcttgtatcgctatggggtcgccctcatgtgcctttatgatagtgtcatagggaagaagtcggttactcatgagacaacacctccatttcctctttcagttgctttaaggcaagctggatatgccgcccgattgtgctgcgtgtccagccgcttcgttctccgatttctttctgtgtcaagtgttggaagtaatacaaaaacatttcctcctgcgtctgttccggcagtcgggcaagcgccgcagtaagggcgcagttatccagtaataccaactgtccccggacagagaacggataggtttctccatagtccggcaccgaaaaatattcatctgtggtgctgaatgggacaaatttttcttcggtcaaatattcaagggagatttcctgtttccacctcgccgccagcatacgggcagcgtcaaaggacgcatggcgaataacaatgcggcaataggtatcatgggtatagcagatatgttcttgataggcttcgtattcagtcatggaaaatccccctttcttcgattatgggaaagggcggcagcactttttgctgtcgccccttgattacccaccagcaaggacagacggggctgtcatacggcgggcacagcccgttcattttaccgttgactggctcgactggatttgctatttcacttaatattctcttttgtgatagacataggcggttacaggacaagaaataacaaatacaagcagtgcacacgcaaaaataattacgccgcctaaaattatctgcattgtagtcataggtgctggaaacaaagtgtttataagggtcgtaagccccataacaaatccaatcccacagagcaagctaattactaaaaatacctcatttcgttcttctccacctatatagaacagcgggaaaaatatgcctcccataaacaggcttattccaatgcctatcacaaatagcatgaaaacatctgtatctttgtcaaaagggaatccatgtagcatgattgataaagctactccaattcccgcaaaaaccattccgacaatcagccacaataaaaagctcaaaaaataactctgtacaatggcagacctctttacaggtgtggtaagtttgtatttgctccatttggtagcactttcctttcgcaggctcgcaatcgaaatgagagaaaaaccaatcatagccaacaacatataaccaattattagcgacgggattgtattgtccatagcgacaacaaaaatacccagtaagagcatgatagcggcaaagactttcgcatttgaaagtgtagcataaaaattattcttcaagagtcctttcatacccgttccccctttaccaatagtaacatgatttcatcaacagaaacatggtctaccacaacacccttatactttttctgtgcttctttcccgttagaaaccagcacatcaatttgaaaatcacgtttccgataagtaataatatctgccgggtctaatgcaagaaattgattttccttgcaacgcataaccgcataattataaaccaaatcattttttgatacggtcataatcagttttccattgtgaataaatgtaatataatctgctatcttttctaaatcacttgtgatatgggaagaaagcaaaatagagtgatcttcctcctgcacaaattcaagaaacacatcaaggatttcatctcgcataatcgggtctaatccgctggtggcttcgtctaaaatcagtaattgtgggtggtgagataaggcaacggaaattgctaatttcatcgtcattcctctggaataactcttgattttttgttttgccgataagttgaagtcacgcaaatacttttgaaacaattcattgtcccaattcttatatagtccttgcatgatttttgcaagttcttcagcgttcaaatatccggggaaattttctccgtcatagacaacgccaattttttctcgtatatcggtatcatcgtccgacatttcttttccgaatagcttgatagttccgctgtcttttgcaaccgtatttaaaatacagcctatggttgttgtctttcctgcaccgttttctccaacaaagcccataattgcaccgtatgggatagaaaaactcactttgtcaagtgcatagtttgacttcggaaatgtcttactgactaattccagttccaaaatattatccatgtcattcgtcctcctgatagaataaggctaacagctctgtcagttttgaaaggggaatattattgttccgtccgatttctgcggctacttgtaaatgttcctctgcaatacgctgttgttcctcttgataaaattctttgttttgcgctgatacaaaactccctctgcctacggtggtttctataaaaccgtcccgttgtaaatcttcataggctttttgaacagtaatgacacttacatggattgattttgccagtgaccgcatagaagggattgcttctcctgcttgtagttcaccactcattatcattgccttaatctgtgttgttatctgctcatatatcggcttgtttgcattgttactgataatgatttccataattcacctccttgctttttagtgtacttattgttcaagtacattataacactcggaattatagttttcaatagacttcatgaaaaagttacaaaaagaacctgtgtccctcttgctcggaatagcggcggggcggctgtccttgttttgtttttgttgttgtttctttaccgtacatgagcatttgcaccgggattatcgttaccatatccttccagaagattgataactccccatacaccgacacctgcgccgattgcggttactactattttaagtcctgttactgatgttgcaaaaaagcccatttgtttgtctccttttcaaaaaataaaaagggagcttctctgaattataatttttagaaaagctcccatatcataagttccatattcagttgtaaaacaacttctggtcacaatgtccagaagttaagctgtgatttctccgacatcgcatacctcatccaccacatcattccccttaaagcggagtctgttgcggttcttgacgtatttttcaatgtcaaactgtgcccagttgcggatcgtactggtccatttctttgtagcttcaaatgtggcaagatacagtgcctttaatagagctgtatcgcttggaaatacgcttctctggcgattcagtttccggtaggtagaattcagagattcaatagcatttgtagtataaatcaccgttctgaccgtcgttgaaaatttaaagatcggcgagattgcgtcccagttatccttccagcgcttcatggaattcggatatttcggtgtccatttttctgttacacgctctaaggctgccagagctttcttttcatctgtggcctgataaatggttttcagatccgtagcgaaggcttttctgtctttatccgggacatatttcaacgtgtttcttacctggtgtacaatacagcgctggtattccgtctttggaaaagctgctgcgatcgcttctttgattccggttaaaccatcggcacagatgattaatacatctttgacaccacgatttttcagttcattcataacggaaagccagtattttgcgctttcgttatcgccaacactgatggttaaaacttctttttttccttccgtgttgattcccagaatcacgtaagcagcaagctttcggatcacgccattatcccttacagaataatggattgcatcaatgtagagaatgggatagacctcgtccagtggccggttctgctagtcttcgatctgtggcaggatcttatcagtcacatcagaaataaagctttcagaagtttcaaagccataaatatcttcgatggtttcggaaatctgccgggtagtcattcctttggcatacatggaaatgatcttctgatcaatatcggaaatatctttctgacgttttttcacaacctgtggttcaaacgttgatttgcgatcctgtggcacttcgatttccatcgagccataccggctgttgacctgtttccgcttataaccattgcgataatcatcattatctgagcgttcggatttttcgtaaccaagatgatcatccatttcagcttccatcatttccttaatggtgccgcctaaaagatccttgagcgcatcctgaatgtcttctgcagactggatatcgtactcttccaggagctgatggatgatgtttcgttttccttctgtcacttgtacacgatgtacaggtttcttttgtcttgccataataaaaggccctcctaatgatatttattgtatcatagaagaaccttataaacattattttacagaaaaagtttcatactctcgaaaaactctatccggtcttttaacacgtgcaatttaaggcgggcaacttgcccgccgtaaatctttaaattatgctttgatttttccagaaaatattttacttactttgtttttcatgagtatgaatacaatttttacttatttccgtatctgcgaaaactcttataaataaaaggcagtaaggctattgccatcactgtatacattaccattacaagcggaatttgtcgaaatacacaattcccaatctgataaataagtgggacttttacacttgcctgtacatttgtcaaaattgttggtatcaaattgaaaagcgttgtatacccagaaagtgcccgtcctataaatggcaataagcaatataaaaagaacggaatgcaaacagcgacactaattgtatgcattttagccgctactaacatagacactacagccgccagcatactggctataaatccacatacaactgtcaacaaatagtattgtccatatgacataatgtaaatactatatgcctgatacatttgataaggtgtattcataccactggttcccataattccaaaacaaatcacactaagtaatataattcccatacaataaatcataactgtcgtagctattcctgccagtatttttgttttaacagcttttgtacgtccatactttgtagagaaaaatactgcatctgcttttgtctgaaaatcatctgcaaatattccagcacaaataaaaccaactatgattgccagaataatagaatacgtttctacatacataatcatagtatcccatgaactataagattcgtattctactggtaattttatttcattatatttcttttccaagtattttttctgtacagaagtctttccatattcttctgccatcttttccatatttttatgataagtgtcatagaactcttgcacattttcttctgtaatttgattcagaacactttcatcatattctgcatccggtgttaataccgatattataaaacccctaatatcatctatcggttgtaatgtcgttccgtaaatcgcattttcttctgaggattgtgtcatcgcatttttattttgttctataacttttccaagttcatcttctgtcaatgtacctttccatgctcgtctgttatctgtaagttttcttgttgccataattccagtactagcatttccattctcatccacatagcgattacttgtaactgcaaatccgctaaaaatgacagcaagtatcaatgccaatccgattgcaaatacattaattttctttgaaaaaattcgttttaattctaatttaagcatcttgtttttcctccgatttttctccaaaataaaatagaaatgcatcttccagatttttttccacagccacagcatcttctgttggcttttctattgaaataattctaagctctgctccggtttttgttgtttttatatttccaaccaaatattcattcatatatttgtctatcatacttctcgaaacattacattgccataccttttctctcatagaagatactaaatcttccgcagtacctgcataaaaaagttctccatctttcattaacataatgttattcgcaatgtactcaatatccgatacaatatgtgtagacaagagcaccaaacgttcttccgacaattcactaattaaattacgaaaacgtattctttcattcgggtctaatccagcggtaggttcgtccaggacaagaatttgcggatcgtttaacatcgcctgtgctattcctacacgtctaaccattcctccagacaaattcttcatttttcttttactgaatttttccattcctacttgatttaataattgtttcactttttttctggcaaacggtatttttaacccttttatagaagaaatgtacatcatgtaatcatatacggtcaaatctggataatatccaaaatcctgtggtaaatatcccagaacttctcggtattcacctcctagtttccatatatctttaccattccataatatttgtccttctgatggttgaacaatcgtacaaagcatacgcattaatgtggtctttcctgctccatttactccaagcagtccataaattcctttttccataacacaattcactttattaacagcatttacttctccgtattgttttgttacatttttaaattctaatttcatacgtgtaatcctcgtataataagtgtatagccagtagaaatgatggttatgcacttatccttcggtattcccatctgcaccatgagcttattgaccggcatctccttcatcctgttactttctgccatcttaactgaatcctcctttttctgcataaaaaaagcatgtacttatctcacaagctggacttacgctgataagctacacactttttcatggcatcataaaaataaaaacgagcagcaaaactggatttacgctcgtttgctactcgtttgaaaatcattatatttctctttttctaaaaagtcaaactaaactttcttgtaaaaaatacataggatgctatttccatactcacttacacgaaaagcccgaatactctattctttttcgcatgtgcatccaactccgcctgtgttgtaatccctttttcaatagcccgcgccttaattgcaggtggataattgtaaagctggtattttgctccctggattctaaataaaacgagcataaacgctgtataaagcagactgtacacgattgcttctactgtaatcctgattaccatagttacgtctctcctttcaggttagttatttctaactgttattttagcacaatttttaccaacttgaaagtccatttactcttattccgactccatctccccagtcgctgcctccataaccgattccaccgacacaacctccggtccggctgcaaatgcttcctctgcatcagctgcttccattggatcctcacgctctttcttttcctcatcatcccaaagcgacttatactttttgcgtttttccaaccgcgccatcattccggcattttttgccatcatgtacagatccttatcaaattccatcagctttttctcatcctgtgctggcacaatgtctccatgcatgatgcgtctggctaccgtcatgatttttcccatttcctcactgtagtctttcgcagcctcgtcctgctgctttgccgcaacactgttaaacttgctttcccactgctccataagctgatctacataatcctgatattcatcctgtttttctgcaacggcattatattgcaaatccagagtggctgcctcatcggcatacaacgttttaccgtccggtgtgctttccatccgttcctttagctcatttcgctgctttgacagtttgaatttctgctgattgtatgatttcagaacagaactgtagattcctcttgcctctcctactttcataatgtctcctccgtgaaatatatccattgtttcccttatatttcatatatcggataaatcacatgattttttaattcactttcaatttcatcttaatatattcgctgaccgcacatagaccagctttcaggatttcggcatcacaggcatatccaatcctcatgctgtgcgactgttcaaaacagtcccctggcgtgacaaaagcacctgtctgcttgtacatttcttcacaaaacgtataagaatcaatgggcagatcatttttgtttccggtgttgccagacggcgaatctcctcaatatcaggaagatacccattttcctttttaagatcaatcaactgcacatctgcaccataggattccggaatagaatacaattgttgataggtcggtctgatgctaatgactctctctcccggcgaaatgagagaataaaacacatgatgattggcacccgtagcaccatgcgtggggataatctcatccaatttaatagttttataaagcttgcagactcctgctttaaattcaggatttccctcaatgttaccataagttaatctttgtttacaaaaatcttctaagaatttattcttatcttcactataaaatctcctttctttcccaattgccaccaaaaagaaaaaagtatccaaggcatcgccttatagcacatttttaatgcgctgtacctacggcggtgtcctgaacacctttcatttaatcgctgcccggtggcaacgataagtgttatatttaattcatatttattttatgttgtaaactacattttgtcaacagcgcatcactatcaccgcctactcgggagtttgacagttgaataatagaaaaagcacttgcaggccttataaaacctgctttttttgcgtcaaattttatgtttttatatatgttattttctgttattgtattgtataataagaaggtgttgcatatgcatcttcatatatcaaaatccaaaaatgcagagtccttttatatctgcaaagggaaggaataaattactatacttcaaaacaacggcaaaaatcgctgaaccccagtaaaatcaatggatacagcgattttttcttctaataactgtcaaagacaggaatatattcttgtatgattgcacagtcaataagcattatataataattccctgcttggtttttttgttttaatgaactttcgttattgctccggcatccatctcgtacacctcatcacagagaatttctatatccagtggattatgactcgctacgaggatggttgtcccttcttcttttaattgaaccagaagcttccgcatatcctccacgccatgtttatccagaccgttcatcggctcatccaaaatgaggatgtccggactttccataattgcctgtgcaattccaagtcgctgacgcatgccgagggaaaatttccccaccttcttcttatcttccggatcaagccccacgagccggatgctctcttttatcttctcatctgtgattttcttctgcagacgcgcaagaagcttcaggttctgaaagcctgaataatcccgcagaaaacccggatgttcaataataattccaattccctgtgggatatccacatccttccccacctgtttgccacgaaccaggattttccccgcatccggcaggacaaaaccacagatgcttttaaaaagaactgtcttgccgcttccgttccttccgatgattccatatatttttccgggtgtgacagaaaggctcacatggtccagaaccgtctgttccccgaacctttttacgacatcctgtatttctatcaaattttccattctctaaatcctctctgccttcagcaaatgttctataagcctgactcaatagcgtcaagtgtgtatgtcttcgattttttcataatgataaatccggtcaccagaataattgcgatttcaaccgcaagaatataccacagcggaactgcatcatcgctccttaaataagcataggtggtcgtccagtgcagtggtgacagaactctgagcttaggcagcctcaccacatcaatcatattggaaaaaacaatccagccaatggccactgctgatccatatattctgctcccaagcatgtttccaagaaagacaacaagaccaagcagcgtacccacaagtacattcagtccgtaggtaatcagacaggcagcaagtggcgtataggcttccacgatttccttgtgcatcaccactccggccagtccgttattttctgcacacatccggataataccgccccagtccgtagaaaatccgacctgcggaatgagtaccagaactgtcgtcagtgcagtccacagaaaatataccagattcgcggcaacaatgtaggcaagctgtccggcaaaccagcgcagccgccctgtcctcaccagaacaaacatctgctggtcatccataaacggggcattacaaaacaataaaaccaccccaaaataaaaaagcatccgcgttattccgtcatccatctgaaaagcgaaaaaatatggtgtcaccgctagtcccacatcctgcgcatactgccttaaataatcttcccggataaatgtgaaaaccaaaacggacaaaaagacgatgaatacccggtagctgcttttccactttctgaaattgttacacatactcctaagcattttccatcctccttataatctgccttgccgcaatcttccacaaaacaaagtagatacagcctgtatacgccagagcataaagcatctgccagattcctccccccagaaattccgcattgccaaagtatacccatgccggcagaattggtcccagctccagcggagcatatttattggacaggcagatgaccatgtaataaataagaatgggcattgccgtcccgacaaatatattgggaatacatgccgtcaccgtcatcgccaatcctgcgagaaccgcacccagcagggacagtagcagagcattccagatattctggataaagtaagcatgattctgcgaaaacatagcataaaacgagccttttatcggccaaagcgtaaaaatcatgagcagttcatacaatgccataccgccaagcatgcttgcacagccgccaagggctgcagaaaaaagatgccccctgatatacttttttgcatcacctcttacgactgcgtatctggtaaaaccactgttacagtcctcacagtaactgagacctccgccaatcacgcagagcagataaaacaggataatgaacccggaactggatacgacggaaaaagcatcctgcagattcgcagaatccccgtctgagcggataaaagcaattccgctcatatacagtgtcagtgccattccaagtgtgcagatatatatttttcgattctgaaacatgcgaagtacatttgttgtaaaataccggttcatatttctcccccctcatttggtctgcagaacttcacctgtataggcatcataaatagctatatatttctcttcggaatcataattcacctcaccatagtgagtgactgtctgcgaataataacatgcccataccggacacatatggtacaattccgtttctttatcgtaaaccggcagatattccagcgaaacctccgacagcttcatttcaccggtttcctcctttgacttcatcatctctacctgtttttctataatgtccgccggacgaagaatctcctgttcggttcccattttctccagctcatacgttggtgcagactgaaaatatgcaattccatccctgtctacacttacttcacacacgcttgaacggaaagtggtatcgtttgtaagttttccatcccccggatcatatctaagacccggaatgccaaagtaatcctgataaagaaatatcgcatacgagaaattcctattttcttcttcctccggtgtgtgattgtcgaatttatcaagatccagccatgatattctcttattcttttcatccagtgtatagcagtccactgtatcactgacctgaattcccattttttctgcataatccactgccagctgttcactctcttttatcgaaccgaacgccagctctctgccggttttgtacagttctctgttgtctcccttataatctccgcagaagtctgactgatttaaggaaacatacccgcgttcagttgaataactaaatctgtccggtaaaacataaacattgtcctcatgatttgaaatctctacataataaattttttccccttcactgttcctgtaacactctacatccttctcctcatatttccaccctgcttcgttcatcattttctgaatcagctcatgtgcctcttcttctgattctgtataatttttttctgtcgcataccagtcggaaagcttccattccgaaagcccccataaccggacatctgcatctaccattaacagatcatccacctgacaggtcagatgatctggaattttctcaacatcatctgtatcaaactctgtaagctcctgtttggcgaccccctccatctgattctggtgctctgtgccattctgctcgggaaactccgttggcgcacaggctgtcagaacaagacaggcacttgtcagcataataactgcacaattttttcttcccatctttctttccccctccaataagcagatgcgccaaatgccgcatctgcttatcataacttcttatggttcccaagttcctcctactgaaaccgtaattccaccgtttgatgaaggattataaccatataaacttacattttcatctttttttaccgttttattgtaaataactgtacacgttcctaagcctctttgttcagtatactccgctgtaaatcccttatctgctacatgtgtacggtacttaattgaggcagacggataattcatttccgtaacatgcacagatgcataggctgtacttccagtttttgctttataggctgtattttgaacattttccggcatgagaccaaatgaatatccataggttgctgccataacgcttgttgttgaaaacatggttaacactaaccctaagcaaagtgctttttttaatttgtttttccttgttatttcctcctgtaaagtacgtttttccacaaaaatttttaccaatttcattctttacttcttttcatgttttatcaaatagattttcctcagtccttccggctccttagtctgataattataccaatctgagctttcagatacggatgcaattgccactgtttttacaagtgacgcaaatacctctgcaaatttcttacctttcatctgacatcctccttcccccatataattagtagcgctacttctattaaaactaccagaatagcaaatgatgcgtccggcaattttatccttatgcttaacgatataatgataaccatcaatgttatgataagtgtctttcttttatttacaattctaacccgttcaaacaatggctttcctggattctctactggtgcaaaaaagaacataaccatgaaaaccatgcaacatataataagttcaattccaaatctagtgaacccaaatttttgttgcagcctctgtaacactattacaactgcccaatttgtgatagtcaaaatataacattttaattttgtcttagcatgataaccacccgaatatcgtcttataccggcaaatacagcaataaaaatgagtgtactgatttctttattgaaaataaaacccagacaaatcaaaaatatagttgtacctatattttcaattaatatatctgaaccatatttataaatctcatattcctcatgttcaattacattttcacgaacaaaaaaatcagctatcatttttgataatccagacataaacacacgtcctttcaatctgatgataactgatttcttaatctttacaattcgtttggcaagttttacctgtttttggcaaaattagcaagtggaattaccatatgtacaatcacattatttgcttcttccgatatatttaaaaatccctgatactgattgacaatctcccgaactgtcgggattcccaatccatgttcagccttattttttttcgatgtgacaagtttaggatttacacaaagaacagagttttgaatgtgattctctacaattagattaaacatttcatctaccacttccatgttaagatgaatttcctgctcctgctctttctgctcagcttcaatcgcgttatccaaaagattcgacaaagcaattgccagttctatcgtatctatattctccggaagcttcacatgaatcacaaatcgtatgtggttcttttcacatatctccttcttctcattgataacagcattcaacatcaaattaggggtataaatctgctgtttctctgacagtttcgtggcaaaagtcttttgcatttcttttttaactaattctaccttaccttcttccaaaagttggagatagttcgagaaataacgtcggatatcatgtcttacttcgcggattttttggttgctttcctctgatactttcatcagtttctcctgctccctcaactgagttcgcaaaatactgttctcaagcagttctcgattttgattttgcaagtggttcaagagccacaacacaagaagaatgattcccagaaacaaaagcgttattactgcaaaagctatctgtaagattcgcggtaacataacctgttttaacaggataataaaaaacagagagacaacaaaaaaacaagcaaaaaaaatcccgcttatcagcaattcctgttgtacaaattctctctgtctttttatagttcttatataagcatatgcgataaaaatgcagagactcttcatgacacaaacctcgataagtctcatcgaattcccatacatcgtcagtttttccattgtcactccgctgaatgctgaaataacataaagacatatgatacttatcagaattgtcaatacattaatcataataacagagatgacttttgaagcaaaccgtccttcaaaatatctctgggcaaaaaaaatacatattcccattccaataaatgacgcaatcagattcgaccccacttcaaaataagtaactgctgtaaatgtgattccaaacacaagatacttccaccatgccaattcgtctctaggtctaaattgcgcccgaattaccgctgtgcaaattccaaaactgataatgcaggccgcaatctctattatgaaactaatccatttcatatatccgactcctcatataaccaaaatattgtttctttacctcttccttcttatctctactgaccggaatatgctgccctgtttttacagtgatttccttcaaattaaaattctgtatccacatgctatttacaagataactttttcccggacgcaggaaatggaaaataagcattttttctgcataatcagatatttttcctctgcttcgcacaacctgttcttcacgctcagaattcattacatgaaatagtaggtaatgagcctgactctctatataaacgatttcctttaccggaagcacaatctgttgctcttttacatctaatgtaataaatcgcgctctcttctccttctgttttttcaagctttgcaacgcttccgaaagttccgcctgtaaatacgcttttctaatgaaacgaaatggcttatagtgaattgcctcaaatacagcctcctcatgattgctgataaaaataacaattgcctgcggattttgttcttccaacttggcagccaattccatacccgttacttccggcatatcaatatcaagaaaaaaaatttctgtctgatgcagttttgtctccaacaatttctcactatccgtgtatgatacaatttcccccactacatttagctgctgcaattctgcccttatttgtttctccaacctcgaaagaaatatttcatcatcatcgcatattgcaatagtccaatgctctatacccataaatggcataaactcgtctttcccccttcttttgtttatatgactattttcgcttgtgccctttgagcagctaccatctgcctttaaggactggttttctgattcgattaaattttcgttgctagttgcgcaccttcgtcaaatagaatactgcaagctgggtgcggtcacgcagagaaagcttatcgagaatgctgctgatataattgcggacggttccctcactcagaaacagttcgtctgcaatctcacggttgctttttccaactccgacaagagcaataatatcctgctccttttctccgatgtcgtagcggctgtaatgtctgacagataagaatcttttcgttcagggaatatatcccagtaatcttttcttgatattgtacctgttctctgtctggcatttagattatcattcacatcctcattataggttccttccttcatttaagcaatacatttcttaactgcatcctgcatccatacaaatagttcttcaacattgtactcatatgaagagtgagcttccagaatcctggactgatagatcagctctcttccaagaaatattgccctgtaatcatcccgttctattgtcacaagatgataccagcttatttcgtctggatattcttcatgccacattttctcaaactcttcataattctctacgacttcttcatcctttaggctttcgtagtcgtcataatcgtctatagttccacgctccgctttcagccacaactctcttctgttatcctctccgcaaggctcaacagcctctaatattgcatataccttgtcaatagcttccaatgtctttttatcaaatacaaattttccgtcttttaacacaaaaatccaatgattcacctttggtgccttgattgctgtttcactcattctttcctgtctcctttccaatgatcctgcttgtatcagaaaagtattttatgaaatctgctttccagtatatttccaatacattattgctataaaccaatatcttctctatcaataattctttcatttcttcagtaagcgtatctgcatcacaaaattttttatctctattcgtcaccaatgagtctaaagaaaattttgaccatgcatctttttgcatatcacatatacaatcccaggaagttccatcctgtcgatatctttctttgttctgctcccaaagaatataacaccctatttttctggtatacagccaaaatagccaattaaaaaagttagtagcaaaaattttaacaggggcgcttgctgttggaatggttgtttcccctacctcagcacatgcggacgaatcagataaatgaaagcttaacggccatagttgttccgaatagcgtaacttatatagaacagggtgtgtttgaatcttgtagtaatcttattagtgtaacattatcaaataaccttacaaatatacccacaaatttatttgaaaacgcattttctttaaccactatctactacagtggtacagccaaaggtgcgccatggggcgcaaccaatgcaaccatcgaggcaaataacactatataatcccaaatcttccaaaaaatggtcatattcatgagtagattcccattcccgttcttctttcacatatttttcaagcatttcctgattatgttcgtcccaaaaaagatcagtgataagatcagtgatggaagaatcactacaccgataagttgctttggtggtgcctatatttttaaccagtagctcccaattgtggttcgaaccatcaaaattcccaaaccaaagcaccagcataagtataattacaccaacaacccccagattaaatttccttttgtaggcttcataactatcatcgtttctcatattttttcctccttcgatttttattcttattattaatatgtgtttctcatttttatgatagagcacttttgtttcactattaatatgtgtttttatttggaaaaaatgaaaaatcacgctgtcgaatattgttgaaacccttatgttggtatgatacaattttcttacggaaagcccatgacaggggtggtagcctcccgagcttaatgacagtttactggaatacataagaagggaggtggcgcatatgacagcttatgaaatcattacgattttcattgggatattagctttgttgatgtcttttggtagtttgattattgcgtttcttacctttctcgataagagaaataataagaagaaataaaaatgccttacctgtcggcaaacaggtaaggctgtgctcataagagcaaaatgcatacttgggagcatccacttttggaatggatactatccgaactgaaaggcatctgttccagcaggtgtctttctttatattcaatatagcataaagcatttgatatttcaagaaattttggagactgttttaaataaaacaccttatacaatcccctgttcgttctgttacatttctttgcatattcttttgttacttgtggtgcatgaagtttttgatttgtcacttttcccagattcttattccttcgaatatttgtgatatcgccaataataaccgtgtggatatcatttgctttacaataattcactactgctctggtcactttatgaagatagtcgtgaatacagtttcgcctatactttaccgaccaaaccacatggtaattaatgttgtatacgcaagtgcgtgaatgacgcttagaatattattcacatgtaggtttatcctcctgggatgacggaaataaaaattagaatatcattcacttgtaaaaagccactgtaaaaggtggcttttggtttaggtaagagattaaatactatagaagaaagaaggtgtctgcttggcagaatatacactttacatagacgaaagtgaaacatttaataaatctttttcccagtaatagctggtactgtttttcaaatgattcatttgtagtgaagcctcgtatatcaagtgcaaaatacactatataatggcacagactttatcccctttaccattccaaaatttcttgttgaaatcctgatggtataaaccggattatatttttccatataaaccatcatacttttcgctttcacatgatttcccgctttacattcaaccggaattacgtgactgtctttttgtatcaggaaatctacttctgccgtattatcggattcccaataatgaagatcatagccattcgttttcaatgcaattgcaacgtagttctctgtcaatataccacgaaaatgctctgtttccttactcctcaatgcttccagcgtcattcccattctggcagacataatacccatatcactatagtataatttaaatgcactcacatcctgatatgctgcaaccggataaaatccctgactacatttcatacacttatttacaattccagcccgaatcagccagtcaattgcatctccatattgagatgcacgcgcgcccgattttatcaacttatactggaactttttagcgtcttttgccaactgcgccggaagagaatcatatgcttcaaaaatgcgcactgtatctgacttattcgcatattttgtcatgtccgcaatataagaatttaataacatctgtctgatttccgtctgctctataggactgtcttttgcaaggtcagctttcaccgctgccggcattcccccaacaatacaataatgataaaattcctgcatagcctcctcatggagcatctcattcaacggctgattattttcataatgttcccggatcgtgtctgtaagcatctgttttccttttgcccacaacacctcttccaaatccattggatacatggtcagcatctgaacttttccaaccggaaatgaatatttttcccggttcaccgccacaccaagcaggcttccggcagccattacatgatattccggagcttcttctgaaaaatattttagcgaagttaatgctctttcacacatctgaatttcatcaaaaattatgagtgtattttcaggtacaatctttgcctgatagtatttttccaaaacagctatcacatgatctgcatgaatatctgtttcaaaatattttccaattctttcgtctgtttcaaaatttacataaatcgtattcttgtaatataatgatccaaactcacgcatttcaaatgtttttccaacctgacgtgcaccataaataagcaatggcattcttccatctgacatatttttccactcatataacttagacgttattttacgtttcatgcgtatgcattctccttcttcttccttcttctccaaaatattttggtatattttaatgtattatattacatcttttcgtatgaatcaatgtgttttttcacatttttattcatatacactatcatataaatcatacttacgcatgcgcaatagcctgaaacataaatttatcgtccccgattgtttcaaacgcctttcccgactaccagcccagatccagcagccagttattcagacttctctccctctctttttcatcggtaatctcctttaaacctgtatattcacccttgatattgccgtccacgataaaaagcaccctgccgcattttgcagcaactttcgcatcatgcgttaccataacgatcgttgtcccctcgttgtttaacttcacaagttcgtccataacctcattggaggaagtacggtttaatgcgccggtcggttcatcggcaaaaagcagtttggggcggttcatcatacttctgcagatacacgcgcgctgaagctgtccgccggaaacctcgttgatatcgttatctgcaatctcgatgattcccattttacgcataagctgctcgcctctttcctgcttctcctccctgctttcctttgactttttactttctgctgccggaagcacgatgttatcgagaatggtaagatttttcatcatatacatctgctgaaaaatgaatcccatctcatccaagcggatttttgcaagttccttttcgctcagtttcgtcaaatccttcccttcaaaaagcacctgaccgctcgttgcccggtccatacccgagatggcatacaaaagcgtggattttccagagccggatggtcccatgattgcaaccatctccccttcttttacttcaagatttacattctttaacacattattctgccttttatcaattacataggttttgcaaagatcttttgcacaaagcaatgctgccataagattttcctccatttactctatattggttgtgtcgttgctcttaatcgtccggatctgtaatgctgtcattcccgatgccagaagcgtcataaggaaaataatgcccggatacaggaaaaagattttccacggacggatcacataagccacttttccggcccccatcatgccgaatatcggattgccgatcagatatgttgccggaatggaacagattgctgccaaaaaaacagccacaagcgtaacaataccgaatcgtgtcatatgccattccatcacccgtttgttaccgaatcccatcgccttaagaaccgcgatctggcttttctcgtccgcaagaaatgaccgctccatcaaaatacatacaagaagcacgacgatcagtgtaattccaagaagcagatactgtaccgattccatcgtcgatgccgctcccatacagtcgtcacagtattccgtggcattcattactttttcattgtcaaaaagctttttgattttttcttttcgaatctctatctccttcgcagaaggatggtcgtcaaaatcgatctgataactcataacattcgcaatataggtaaaatcggtcggtgcatcctcgtgaaggcgtatgacctctccaagctgattcatgctttgaaaataagcaaccacaacgcagtcaagtgtctcttttccaaaatcaatcgttacggtatctccgagtttcgccccggtcaatttgctgaccgtaggtgtaatcgcaatctcatttttgttttgcggaactaccccattgatatattcatacgcggatgctttcgtatggattccctgctgacaactgatggaataatcttttccgtcaaaatgaaccttatatttgtactgcgtttccacacacagtttcgcaggcattccgtttttcttaaacagcgcttccgtttttgcaaagtactcctcgatctgctttcttccatccggattcatacaactcatcacttccgtcagatcggtgtagtacagatcactccgcgttccgaatgttgtaataaacgtatcgcttcgcatggttgatgagacgttgacaaataccagcacaaacaacgtgcataaaaagaatgtagttatgatcgtcatgtaccgtttcggtgcgctgaacacatcattgaccgccataaagaaaccggtgcttccatggcttttgaccagacgaaacggcgattttttcttataacgttcccccgtctgaccggaacggatcgcatcgatcggagaagacttcttcaccagcttcgtgcagcgaaaagcatacagcagaatgacaataacgaccagaattgcccccagaaccgacaacaggaaatggttatccgcctctagaaccatattgctgctgaccgatcgcagtaacaaatcagaaaacgggatactcataaaaaatcccacaaacgctcctattactgccaacatcagatactttgtcaggtagagactccggatcttgaaattgctgataccgattgctttcatcacaccgatctcacgaaactcctcggagatcgtaaacgtgatggaaaactttaatacgacaaacgacacgatgatcaggcagatacttaaaatcagcatcgtaaacgcaacgatcctatccatgacatagcacatttttatcagcgaacgtgcgccggaaaacatgatgcccggagcctgtgaaatagccgaagcaatctccgatacgcctgcctcatcctttagatcaatatagctgatctgcccctgatacccattgtaaatggtttcatccgaaagcagcttctcaatctcctcccgatgaaaaaggaaacggctgttgcccatcatggaagaccctaaaagcgcatcttttgccataccatccagcgttaccataaaagaaatactgttgtgcgtaatcctgattttatcccccggctgcaaatgatttttctccataaaatcaccggttgcatatgcatgccccggcttgatctgggtaatctgcttattctctttatcaaagaatttaagccggctgtcctcgatggactgataaataacagaattctttgcctccagttcttctccgtgcatatctttcagattggatttttctccgaatacaaccggctcaatgcgataatcccggatggattccatctcatgcaggatctcatcgatggtcgctttgctgtccgcacccatcgagatgaccacataatcgccgatccccgccttatccagataggaatccgttccgttcatgacggaaacaacattgctgattccgctcgctacgaacatcgttgccagcagaataaaacaaagcaatattgcgttcattactttttttcttttcaaatcttttttcaaaatacgaaaaagcattttaacgttcctcccctcgtttgatgtactcatcttacaggagaaattattaaacaatccttaaatgcacattatgcctttcgcacaacgactgtcgcgcagaaatcatcttccttaatttccgcaaatacttcaccatccattttttgcatcaactgccggctgatatacagtccgagtcccgaaccatccgctgagccgacattgcttccgcgataaaaagaatcaaacagatttatgagttcttcctgctttaagctgcatccggaatttcttaccgtgatcagtctgcagtcctcttcctccgaaaagtcgatggaaatacacttgccgtccccgtatttgatcgcgttttccaaaaggttctgcaacacctcgatcagccggtccgcatcccctttcagcaacagatccgtgtaggatgcaatctgaaatccggtatgtaaattatgcagtttttcctcataaagtccccggatcgcatcgatcacatgggacagatacacttcccccggattgacactcagttgcaggaaatcctctctcgatgcgagcgtgatctcattgacatactcctcaatctcttttacgttcttttcaatcccctgacatgcttcgacacgccgctccccggtcgtataaagattttctgccagcgccttcgcatacagccggatcgcagataacggcgtcctgatgtcatgtgtcagcgacaggatcagcgtctttttttctttttgcagcgcgagttctttttctttgttgctctccaatatttcgcgcagcatatccattccccataggaatctgcctaagaatttgcttttttcggctttgaccggcaccgagagattgcctttcgccagatcctcggtcagcgactgcatctgttcaaacggctttatgatcttctttccgatataacaaatcagaaaaacagacagcaaaaacagaattcccaaggcaatatccatgagaatccaggttctgtcgtctgtctgtgtataaatgatcctgtagattgttccggttttatcctgcacacgcgaaatgcacggttcctgattatttgctgtcacataataaacgatattcgcaagtgcaataataagcagctccactccacaaaacttcgctgcaaattttttgtaattattcatatcggtatcccgttccccaaaccgtaataatgtgtttcggcttcttcgaatccttctcgatcttttccctcagccacttgatatgtaccgtgagcgtctgcagctccgattcactgtcgcttccccagatgcggttgaacaggtattctttcttcaatgtcgttcctttattttcgaccagcagtttcagcagctggaattccttttccgtgacattgaccggtgtttggttcacggtgagtgtctgcgtgacattgttcaatttcagattgtcgcatacgatttcgtccaatgcatattttcgtttgaaaatgccgttgatcttggcgatcagaatatcgatatcataaggcttacagatgtaatcatccgcgccgatctgcaagccttttaatgtgctttccttgtcgtctcttgcagtcgcgatcataatatgtgcgtttgaagtctcccttattttggaacagacggaataaccgtccacccccggcagaccgatgtcaatcacaacaagattggcaccgtactgctcaaagatctgaagtgccttctccccggtgtccgcaaggctcaccgtataattttcttttcggaggaaatcgcacaaaagtgttccgatctccctgttgtcctctacgacaataatgtccggcattattttacctcatgtcctgtcacggcctcaaagtgatattttacaattccaaggtcaatcctggaataaaaaccaccaagatttttggctgttacaattccgtttttcagttcaaaataaaacttctgctgattgacagcagttggtgcaagacttaccgcttccatacctttttcaaaccattcgttcttctgatccgcctgtccaagttctgcgatacttttgcttttatgtggaactccctgtgtttctccatatcccagtgagataataatgagtagcttctgtcctcttttgatctgcgcttttgattttccatgcgtcattgccacccagcaggtattaagcccaagtttctgacatttcagcacaatcttctcgccataatatcctgccttttcctgatcattcttatttccgacaatcgcgatataattctttacattttcaaattttccgtaatgagccataaatgaatcaaaacatttcggttcatcgtaaaaaacctgtatcgacagtttactttccgcattaacatcttttatcaacgcattgattttttctctctttgaagattcaattgcctgatttttatactgtcttacgctgtgtcgcgctttcatggtctctaatatatccattttaatatcctctctttcgttcaactgattaaaccgagtataccatatctttaaaaaaaaaaattcaatggtaaagaaaatcgagaccattataaccttttaactttctttgttagttttatcatagttctacagtttttcccagtcaatcttttccaattgtaactcccggaactataatagtccctgcgccgatccagacattttccccaatatgaacggtcttgttatactgcatcgcattttcacgaagtgatggctcaatcggatgattcgcagttgctatcgtaacgtttggaccaaacccatatgattttcctccattgttgctgttcttatcctcgttactcttacctcactcctaccaatatagcatgcatagaatttattaacaaccggaaacgccatagaaaacaaccgtaaaaaattttttacttgactttaatttcatttttctgctaaaatgcaagagttgtaaaaacaaattaaatacaagacacatatcagacaataaatgtcacctgtccactgtcagacggacgggcagcatttgttgtctttttttgttgtcggaaaggaaacactatggttatgaaactcattcttgatgcgattcaaaaatacaacggaggaaaagaaaatgcctagaacacgaggagaatccatattttttacagcgatcaccgcatggatgatggtctatgtcatgacagtctataacacggtactcgcaacaggaagctttacaaatacgacctttcttattgcattgaagggaatgtggatagagtatatcatcatcggattgcttgcctatttcgtgtccggtcatctctcaaaaatgtgcgccttccgcgttgtccagcctggcgaccggccgatttttatcatctttgcgatccagactttcacggtaatctggcaggttgcattcgccagtgtgatcggtgtctatcacggacatggatttaccgccaactttataccggattatcttatgacctattgcaaaaattttatcatggcatttccgctgcagcttatttttgtaggaccgcttgcaagactgatcttccggacattatttatcaatcataagaaggaaaaaagcaccaacgagattcagaatgacgatgagaaaatcgttgcaaaaacaatgtaagctatttatatgcaaaagcaatcaaaaaatcaatcgtaaaaaaatacgattgatttttcgattacttatacgcattacaatgaattaaaaagtcagccgcatctgatgccacacagcgtttccgtgtgtggatttatcggacacgccttcatcaacaaaactaaattttgcataatacttgatcagtttttccttgcaggtcaacacaagaccttttctgccctgctctcttgcatccttgattgcacattggatcagttgtcctgcatatccgtgtttacgataatccggaagtgtattgacaccgaatatcatctgccatgcaccatcctcgttgtgcatagcagccttctcatacatttcatctgtcaaatctgcctcatcggttacaaaaccatctacaaatgcgatcagtttgtcttcctccaacataatccagaagtgatttccataataccggattcgaccggcaaattcttctttcgttgcagcctccgctgctgggaaacactctgcctctacatttgcaatctcgttaagatcatccatggttgctgttcttatcttcatttctcattcccctaattttcattctttcccttaaattttaccgcattttaaggacaagtcaatccaacaacactccctgtgctccactaatatataaagtgtgtatcaacgaagccagttcatctgtttgttggttgataaacgtttctctaacttttataatattgtacaacacagtgttggataatgaaaggaagagttatatgaatgcaattatcatttattattcccgttctggaaatactgaaaaaaatagcaaaacaacttcagtcagatctgggtgtcacatgtatggtatctcttaattgcacatttgttttcttctatttcttgcaatccattatgatcttctcacacagatcatatcccagctcggaactgttcagtgacaatgtgtaattctttgccatcccccacttctgatccgtataaaatcgataatttgtcatacgccttttatcgatatctgccatcattttttctgcttcctcttcggtaacattgtacagtttacagatacgcgccaccttttccggcatatccccatgtataaaaacgttcagcacattatctttgtcttttaagataaaatccgcattccgtcctatgatcacacagctttccttttccgcaatctccaaaatcacttttctctgcgcttcatacaccatatcttccacggattttccggtgatgtcacgtcctgcaaacgcataggcaagcagtcctttcttcggagacaattctgccttttcttcaatatattccgctgaaaatccggactgctccgcaatctgcgcgatgatatccttgtcataatactttatgccaagcttctttgccacttcttttccaataaaacgaccaccgcttccgaactctctgctgatcgtaataattcttttttccataatcacatctccctttcacttaaaacatctacttttgttttacggattctctttaaaaatacatagccggccagacacgcgataagctctgtgatcgggacagaagagaattccactgtataaatggatggtagaattaaactttgcaattttcatgataagtctgaccggttttttacattgagtaagattgaggttcgtgatacaatacatataaatagttgaaaatacggggaagaacttggaggcggcgtgtttcaaacaattgatataaaagcatataggggattaaagaacattacattacaaaatctcagcagggtaaatattcttgtgggagaaaacaataccggaaaaacatctatagttcaaataaaacaaaaatcgcttgaatttgattaaaggtacaaagggtggtatattggtatcactgggcaaggcagaagccttcaaagaagcatatcataatagaagatataggagcagatgaatgaattatcgtggcactgagaatatagaaatctacgaacgaaaattctctttggaacatatttaccatgttgcaaaatggtaactttttgattttggagaatgatgatactctgtggaaactgttatattttttggacggaagatatgaagctgattaccggatagaagagaattcattgtatcatggtaatatacaaatgttgcgatctgatgaatcgagactcgcaatgggactatatgataccgtgatttcttttcagattattgattaccggactcctaaatatctgcatatgagcataggaaaaatgatagaacactggaatattacgagagaacagtcaatcagggaaatgctgtatgatccctatgaaatcagtgtgttaaatgatatcacaaaggatatgaatcatattctgaatcgggtacatttgcgtggcttttcatctattatgagatatcgaacactttatatgctgatgaactggtttgtttacaccggtgtgtggcatgaagaaatggaaatgcaagaacagttattgcttgaaaaaacacttgaatttatggagaagcagggaaagagaattgatgaactactagatgtaacaaattattttggagattatattttttatgttattgatcaaaataaaaacagaacttcaaaaagaatcagcaaaagcatattagataaatattttggcatacttgtatgtttgttggatatggcaaaacgcagagagactgatcaagaacacgttgattatattttattggaaagaggagtatttcttgaaatctgtagagagatggaaagacatcaattgaccaaacgaagcattgaaggggcatttgaaagatgggaaagggaattatagcatgattcaaacaattcatataaaaggattaaagtgttttgatgatgtaaatgtgggatttcgcaaactgaacattctggcaggagctaactctatcggtaaatcgactatattacaggcaatccttgcattggtacagagcggaaaagatggtggaaagcctttttgtggagagtatatcaatataggaaaagccagtgagttacggaacaagtatattggcagtgatgtgattgaaattggtgttaacgaagagtattcattaacaatacctgatgacattttttggaggaaaacaggtgaatttccagcggcagaattaaatgtgcggtatgtatctgcggatcgggttggagtaagggaaacctacggacaaaacatccggggtggagatgaaatcggaatcagatgtgaatatgcatatgactatcttgcaaaacatgatatggatccatggcagaacaatctgatggtgtatgacgaaacttcgaaattaacctttggtggtcaggtaaattactggctggaaaagatacttggttatacggtatatgcagaggaaatagagagaacgacattaatccgggtatcttatggaaaaggcgatatcggaaatggaatcagtcctgtcaatgttggcacaggtgtgtcctatattgcggaagtgattatatctgctctgtcgtgtaaaaagggagatgtgctgattattgaaaatcctgaaatacatctgcatccatctgcacagacggaatttgtcctttttctgacacatctggcaaagtgcggcattcagattatagtagaaacacatagtgatcatatttttaatggagtcagaacaagtgttcataaggactatattgacaaagaagatgtgtctatctattttttccaaaagaaagaaaatggatgctcagaaccggttcttattgaactaaatgatgaaggaaaggtattgaatcaaaaagaggggctgtttgatcagattaagaaagatttggatgttattctggggtggtagatggagtttatactgaatgaagaatccttgaaagcacgaaacgtgggaaaatatagatcgtgatgatggtttagagtataaaaagtatacacctgattcaccaaagcataactggtataatggttctatgtatcgtgataagcagattatgaaattccgtgccagttcgcttttacgtgtacatggatacagaaaaggcgataaattcagggtactgagatttgagatagatcataagcagagtgatcatggatagaaaatgagattgaaagaataataaaaagatagatatgaacaataacatgaatgatataacaagggtaggtttgacagcgaatcaactgaagaatcaatttccaagtatggcaatattactttgcagatacgaaagaaggtgcactcacagaagtgtacaagcattgcggaagtaaaaagccgagtgtacagattgcaaaattaaaaaaatgtaaagaagcacggctgatcgatctgtctcagaatgtttcaaaaaataacaggttcattgatcatctgcggtttaaagttgataacactccgggaaaaatcgtgaaggagtatctgcttccgaattttgtggcaggatgttgcaagaaagtggggatagatggtatcaagtatcaaggagatggatacaactgttatgtgacatggaaggatgactatttttcatttgagggaaatgatattgttgaagtagaaggataaagattctgtgtggaaacagttgtttttaaaatatttctaaaatgatgaaaatgggattgttgaataacaacatataacagtggtcaaatgtagaaataggagaaggcatccctctaaacgcggtattaaaatgttacggagatatagaaattgaggcaagtgacacagcctatgaagtgagtacagaaacagctaatttattgtcattaaatcatatagcatgtcagtgatgatttgatgttttttaaagctgaaggataaagatatcaaaacagattggaaagaggaaaacatgaaacgagtcctgatgttggcgtccgtcgcctccatgattgatcaatttaatatgccaaacattgcattactgcagaaactgggctatcaggtagatgttacctgcaattttatcgaaggaaatacctgctcggatgagcgtgtcgcagaattgaagcaaaaactgcaggacatgcatgtgcgctgctaccagattgatttcgcacggaatatcaaacacatgggacagaacatgagggcactgaggcaggtagaaggtttgatgaagcaaaatggatacgcattttgccactgccacagcccgatcggtggagtggtcgcaaggattgcaggacaccggaccaggacaaaagtgatctatacggcacatgggtttcatttctatcagggggcaccggttatgaactggctggtgtactatccggtggagaaggtgctgagccgatggacggatgtgttgataacgatcaatcatgaggactatgccagagcaaaaaagaaatttcatgccggaaaaacctattatctgccaggaatcggaatcaatctggagcgattccatgcgggagatgtggaaacaatccaacagaaacggcaggaacttggattgcagccggaagaggtgtttttgctgtctgtgggagaactcagtgatcgtaaaaaccatgtcgttgtcattgaggcaatgaaacagctggttcagagacattcgcagctgagatattttatttgcgggcagggagaaaaaaagcaggaactgcagcagttgatccggaaatatcatttggaagatcatgtgaaactgttgggatttcggacagacgtggcagaactctgtcaggcagcagacgtgtttgtgttcccgtccaagcaggagggacttccggtagcattgatggaagcgatggcttgcgaggttccggtagtgtgtagcaggattcggggaaatacagatctggtaaaaaatggagagaacggttatctggtaagcgcagatcaaccggaggaatatattcaggcaatcgaaaaactcctgcggatatggaagaatacggaagaagtccggcagatgagaaaaaataaccgtgcacggataaaacaatatagtttacagaagattgacaagatcatggagaatatataccgctaaatattgcaaattatggggattatggtagaatagtagaggtattttgcgaatttgagataaaatctgtataggaaaataattgattatgaaacaaaaatcttactatttaaaaatatttctgattatagaatgtgtattattgatttttctgggaattttttatttctcggcaggaagatcgttatatgaaagagattccgatggcaatgttgcggaattcaatgcgacaaatgatgtaggagaacttacgcagggagcaacggtagaacagatttatacgtcccaaatggatttactggattccataggtgtaatggtttcagattatggaaaaagtatcaatcatggagttgagattcaatgtgaaaatctgtccaagggacagatacttgcaaaaaaaacattctcagcggatgaatttgaagtaaatcagtatgtttatttaaacattgcagatggtgtaaaagttgatcgtggagatcagattaagatttcctgtacatccgatggggaagcaggggatgctccgaccgtattatataatgtagaaaacaaactggaaaacccggatgttgcgagagatgcacagtttattgtgaatggaaatgttgttccgggaacaatgtgtattgcggtcaatgggcggaattatgtctggacaggtccaaattactggaaactggtattacttgcagttgtattagtggctgttttgtatggaattgagtgcagctgtgacaaaagggggaagacaacaattttatttaacctgttgtttgtcctcaaaaaatataaattcttaattaagcagcttgtgaagagagattttaaagtacgttataaacgttcggtacttggcgtgttttggagctttctgaatccgcttcttatgatgatcgtacagtatgttgtattttcccagttgtttaaatcagatattgaaaattatccggtatacctgttgagtggtacggttatctttaacttctttaatgaaggtgtgggacagtctctgacatctattgtgggaaatgcaccgctgattacaaaggtatatttgccgaaatatatatatccggtaacgagagttttttcttcgggaatcaacttactgatgtcattgattccgctgatcattgcagcacttattacaggtgaaaagatcacgtgggcttatttaatgcttccatatattttgatttgcgtcatgatttttaccatgggattcggtatgattctggcagctgctatgacgtttttccgggatatgcaattcttatggggagtgctgagcatgctctggatgtatctgacaccactgttttatccgatttcgattgttccgaagcaggtacagggactggtactcaataatccgatgtactattttgtcaatgcttttcgaaccatcattctggaaggcattacgcctcgaccggttgtgttctgtcagtgtacagtggtcgcactcgttatgctgggaattggaagcttgatctttaagaaaacacaggataaatttatcttttatatttaggaggaattgcagaaaatgccgatcgtttctgtgaaaaatatatcactgaaatttaaaatggaacagaaccgtgcaaattcattaaaagaattttgtgtacgctggctgaaacgggatttgaagtcagaggatttctgggcattgacagatgtttcttttgatgtcgaaaagggtgatgtcattggaattatcggacataacggagccggaaaaagtacattattaaaagtgatttccggaattatgaaaccgacaaaaggaacgatcgaagcgtatggaaacattgtgccgatgctggaactgggatcgggatttgatatggaattgtccggcagagaaaatatatatctgaatggtgcaattctcgggtattcagaagaattcctgaatgaaaaatatgatgaaatcgttgcattttccgaacttggaaattttatagaggcaccactccggacttattcctcaggaatgcttgcaaggctggcattttccgttgcatgtattgtggaaccggaaatcttgattgttgatgaaatcctgtcggtcggggatgctgattttcaggagaagagtcgtgcgagaatgatggatcttatgacaggcggaacaacggtattttttgtatcgcatagtttaaaacagatccgggaaatgtgcaacaaggttgtctggctggagcatgggaaaatacaggcgatcggaaaaactgaggagatatgtaatatgtatgaaggggcaaagcatgagtgatataaaaatccttgttgcaacgcataaagaattttaccggccggaaaatccactgatttttcaggtgcaggtaggaagtgcattggcagatcatcatatagaaggaattcttcatgatgatgagggcgagaacatttcaaagaaaaacagatcctactgtgaacttacggcacagtattgggcgtggaaaaatctgcaggcagactattatggcttttttcattatcgcagatatatgagtttcaaacaaaatttccccgtgacaaatggcaaaatacaactgaagcgatggacaccgtatttggaagcggattctctggggggggatctatctccttacgatttggatgagatgcatatgcggcatgtgattgaacaatatgatgtgattacagtgctgagtgaacatatggatgtgacagcatatgaacagtttggacagtttcaccgtatcagagatctggactgtgcaattgcaatattaaaagaaatacatccggaacaggcggcggcatgtgacgcatatatgcaatcgaaatatatttatttctgcaatatgtatattatgaaaagggaatactttcatgcatatatgaactggttgtttcctgttttggagaaatttgagagccagacagatttttccggatatagtgataaagaaaagcgtgtgacgggatatattgcggagcgattgtttggcgtgtactatacctggttaaaacagcagggatcggcaaagtgtgcggaggttccatatgtgattttccaccagaatgtccgtgagtttcaattgggcaaaaaaggaccgataattaaggtggatatgaggaaggtcaatcagctgataccggcaggaactatgagaagacgtatggtacgcagacttctgagaaaggaattatagaaatggaaattcaattacaaacaattctgcagcctgatccggaaatctgtgttgaagaagccctgtattttcatagaatgggagaagagatatgttttgatggatatttcaatcttttttatatcgagaaatggaagcggtatacaagattggaaaaattgcagttgtctatcaaaaccgcaggatatcaaatgcttcgactctttcataatcgggaatgtgttgatgaaatcaagctggaagaatcaaaacatgtgtataccatagaatttccatgggagaaatacacagaaggtgttttctggttttctcttgtgccggatgagaagtgtaagatgcagcagatatcaggatattatatgggggtgtgtgaggaggttgcacatgtggcaatcgggattgatatctgtacatatcgcagagaagaatatgtcctgcgcaacttaaagatactctgtgagcgggtattgcaaaatgaagaactgcaggtttcgaaagccttgtggggatacatcattgataatggaaaaacattggatgcatatgaaccattgcagcagtatttaaaggcgtggcaggcgagaatttctgttataccgaataaaaatgccggtggagcaggtggatttaccagaggtatgttggaagttttagaagataaagaagaaagacagttaacacatgtagtgcttatggatgacgatgcggtgttagagccggatttgtttgtacgcatgtatggctttctgtgtgtggtgaagccggaatggaaagatatcattctgggtggaacaatgcttcgggaggataaaccgtatctgttatttgcgtcaggagaaacctggagtaagggattgatcaagaatgcaaataaaaatctggatgtgcgcgaatacgagaatgcaacacgggaaaatcttattacaacaaaattggaaaaaacgctgtattcgggctggtggtgctgctgttattcgctaaatgttatcagggaagacaatttgccaattccgttatttttgcaccatgatgatattgaatttggattgcgaaatcaaaagaatggaattgtttttttgaatggaatcagtgtatggcacagatattttgaagatttaccaccaggaagtaatttatattatgatatccggaatgatttgattgagattacacagcaatatgatcgaaaaacagcaaagaaatatttgtggagtttttattggaaacgtctggcggtaagagttgcaagaaataaaaaggatgaagtttattgggcaattcagggggcaaatgattttctgaagggatcggaatggttatggaaacaagatccggagcagcttcataagaaaattagaaatgtggggtatgattgtatcattcagcgatggtgtgaaagtgtaaaaatttgttgtagattgttaatcaccagaaaaaaagtgattacggattaccaaacaaatatgagtaaatatacaataaaaaaagcatggataaaatatttgggattgtaatgcaggaggaattagatttatggaaaagaaattgcagactttgatctttccggataatgaaaaagttcaaagacagtggggaatttattatcgtggaaatcggtgcgtgcagggaaaagatgatgtgaagttgtatattccagcattcgaagtgattgatttttctacattttttaacgggttttcttatagaaaatggaaaacatatacgaatttaggtgctttacatctttatatagaaatgaaaggaaattttgatgtagaattggttggatatgattatcatggaatccagccggaacgtcacagttatgcaacttttcattatgaattggataagaaagaaaacgtttgtattgcgtttccggatgaatgtaaagagcagatggtagcatttgaaattcatccatatgcagattgtgagttgtatggtggttattatacaggagaatatttggaaagtgatgtcagagaagtggaactggcactggcaacaaccacctgtttcaaagaagaatatattatacataacatggaattactgaaacatgaaattctggaatcggatgatgaaattagcagacatttctatattcatgtggtggacaacggaagaacattggaaccggaaaaatataactgtgatcggttaacggttcatccaaataaaaacgtaggaggttccggcggatttgccagaggaatgatagaatcattgcatcaagagccaaaagcaacgcatgtgttgttgatggatgatgatgtgattattttaccggaaagtttaaagagaacatatacgctgttaacacttttaaaaccggaacaccagggaaagttcattgcaggggcaatgcttgcaatggaagatatgtgtgtgatgcacgaggatctgggaatagtccgtgcggatggagaagtgtgtccggttcatagagatctgaatgttactgaattggtaaattgcctgaaattagaagaaaaacgtccaaaagttcgaaatgagtttggcgcatggtggtattgctgtatgccaagggaagcgattggaaagaatggtctcccactaccaatttttattcgcagtgatgatctggagtatggtttacggtgtcatcctggatttatcacgatgaatggaatctgcctgtggcatatgggatttaccaataaatttaatccggctattgatttgtatcaggtatatcgaaatatgcttgttatccaggcaacatctggtgtgtgtcagggaattgattttatggcatggatcaagcgactgtataaacagatgatgctggagttcaattacggatctgtggaattattgcttcgtgctttggaagattatatgaggggaccggagttccttatggaagatcatggagaggcaatattaaaagaaaaccgaaaattagttgagactttggttccgattgaaaaatttgaggatgagcgtttcaaagacattgatattcatatggatagagtatatgatccgggaatcaggagtcgaattacacattggatttatagaattacttataatggacatcgtttttggccagaaagaaaactgaaggataagccagaagtgataggatacgattggtcttatcagcctggaaaacaagcgcttagaaagtatttgttaatagttaatccgttgcagcagacaattggattaagaacgattgatcggaataaatttagaaaattgcaaaaacgttttaagcatgatttaagagaatattatcagaaaaaagatcaattgagtaagacatatgctgatgcatatacaatttttacatcggaggagttttggaaaagatatttggaaatataaaaaatgttaattcttgtatttcctattatgcgatgatataataaattattatgcatttgaaatagaaaaaagaaattggagaattagggttatgtcgattacatcattgcagttcataattttttttgtggtttcattggtcatatattaccttgtacctaaaaaaagtcaatggatttgtttattaatatttagtgggttgttttttttgctgtctagtaattggattactggtatatatatgattgtttgtatatgtacaacagatttttgcgcaaaaaaaatgagtcaatataatgaaaaaaaaatattggcgaaaagatatttacttttaggtataggtattaatgcaggaatgctgatagcattaaaatatagtaattttgttattgaaaatattttaaatatgctttcgctgtttggtttaaaagtacctcaatatagagtaaatttatctgcccctattggaataagctattacacattacaggtgatagcatatttagttgatttatatggagaaataactgaatgtgaaaaaaatatttttaagacagctttatttataggctattacccacaacttacttcgggaccaatagcgaaacattcggatatgaaaaatcaactgtatgaaggtcatgtttttaatatagatagaatagttttcggtatacagagaatactttggggaatgtttaaaaaactggttatatcgtctaggctaggtgtaattgttgatacaatatattcagatatagatatgtataatggattatatatttggattgcggcatttgcttttttgattcagctatatactgatttttctggatgtatggatattattattggtgtgtcagaatgttatggaataattttaccggaaaactttgattctccatttttttcaagatctgttcaagagttttggcagcgttggcatatcactttagggggatggttaagagattatattatgtatcctcttatgcgaacggaaacatggcggagaatgacaaaaaaaataaagggtaaatgggggaaaaaagcagcaaaacagattccctcttatcttgcaatgttagttgtttggttaatgtttgggttatggcatggaggtgactggaaatttattttaggagaaggaatgttttgctatctatgtattttgcttgcaaaattgtttgaaccattatttaaaaaaataattgatgtatttaatattaatacagaatgttttagttggcatttatggcaatctttccgagtgtttgtattaatgtcagttgctaatatgttttttaaattagaaacatttggaaaaacaataaaagctttaaaaatggcggttataaattggaatccatggattttatttgatagatcgctgttttctttaggattgtcagaaaagaatgtaaaattagtgggaatatgtttattattacttattgcagttgagtgcttgaaacaaaaagagagtattagaaaacagattagtaaccaaaatattgtgtttagatggtcgatttggattatattatttttttcagttgtaatatttggtgaatatggtactggatacgatgcaagttcatttatttatggtaatttctagaaggtgttagttatgcgaaacaagaaaaaaaaaataggattatgtattatatttattgttataattattggaatatattgcattataaccccaatatttaaagaaaaatcagttgaaggattgtcagaggaatacaagacgtttggaaaagacaaatttgaaaccatttttgttggatcatctgttatgcttaatgcagtgtatccattagaattgtacaaacaatatggaatggcatcttttaatttaggctgtggtgcgcaaagaatgtcttcatcatattatattgttaaacaagcaataagagagcaacatccaaagttgattgtgcttgatgtatatttggctggaataggaaaagattatccacaagaaccagcagggtttacccattatgttactgatgcgttacactatccagaaaaattggaaatgataaatgatgtattgccagtaaatagaaggcttgattatatatatgaaatgggagcctatcatgaaaggtgggaaaatataacaaaagatgattttgaaaaaattccgtcaggaagaaaaggtacatatggtgccaaagtgcattattatagtagtccttttgagagttttggagatgtaacaagtgaaaaaaaagagttgcctaaagaaacagaaaaatatttgagaaagataattgaattgtgtcaagaaaatcatacagaaatattgttaaccctaatgccattagattattcggcacaagtaacagatattaatagaagtgaatggcaagggtattggaataaagtacaagatatagcaaatgaatatggaataaggtatcttaatttcatgtaccattatgatgaacttgatttggataaggaaaaagatactgatggaggaactcatttaaatggttggggagcagataaacttacatcatatcttggaaattatataaaacaaaattataaattgaaagatgtcagaagtgatcctaaatatgattttatgaaaaaggatgtcgtcaaatttgaaaaatataaaaaggaattagagttagcttcacttagtgatttttcagaatacttggatgcattagtaaagttaaaaaatgaatatgcagatgaatatgatgtttgtttttctgttcgtgatattcaaggatattttttggatgataatataataaagaaaatgaaaaaaataggatttatcaattcagaaattttacttgaaaaagaatatcatagttttattggaattacagggggaacagaaaatatagaaaaatatggaggcgatgaggccatttcgtgtgatttttatactaaaaataaaaagaaaatagcaatatcaagtcaaacattaaattctggaaataattctatagtacaaataggtggagaaaattattcaaaaaacatgaggggatttaatatagtggtttttgatgctaaatctgaaaaagtaatagattctgtaaactttgatacacacgtgccagagtttacatgtacaagatagaaaggagagaatatgtatacatttagagaattgcaaaaagctgcaaaaaaaaaggtggatgggaaggaagtgaggattgcagttttaggaaattgtgctactcaatttttttcaaatgcagttcaaggatattctaaaaaggttggaatgaatgtaaatttgtatgatgcagattacaatcagatagatgctcaattattagatcgtaattctgaggtgttaaaatttgagcctgataatattattttgtggctaggaacagagaaaatttatgaggaatttttagatattaatttagaagaaagaaatggctttgcagatatgtatattcaaaaaattcttcattattgggaactaatagaaaaaaatagtcatgctagaataattcaacttaatttctgcgaaattgatgacaaagtaatgggaaattattcttgtaaggttgaatctacatttatctatcaaatacgaaagcttaattttttgcttcaggaaaaaatgaaagatagaaaaagtgtttatccggtagatatattaagcatacaaataaaaattggtgaaagggatttttatgatgcgccactatattataatgctaaaatgaatgtgtctatcaatgcattaccgtatttagcaaaagcagttgtggacgttttagttgcaattaatggtaatataaaaaagtgtgtaatttgtgatttagataatactctgtggggaggtattattggagatgatggtatgggaggaatacaaattggagaacttggtgcaggacatgcttttacaaatttacaaagatggattaaacaattaaaggaatatggaattattttagcaatatgtagcaaaaataatgaagatacagctaaagaaccatttgagtgtcatgaggaaatggtcttaagaatgaatgatatagcgttattcgttgctaattggaatgataaggcaacaaatattaagatgatacaaaaaggacttaatattggaatggattctataatatttctagatgataattcatttgaaaggaatcttgtacgaaatttaattcctgaaatagaagttcctgaattaccagaagatccggcattatatttagagtatattcaggaacagaattattttgaaacggcatcatatacgggagaaaatatggatcgtacaaaacagtatcaagctgaatttcaaagaaaaaagctagaattatcgtttacatccattgatgattatttgaaaagtttgaatatgataggtacagttaatcgttttgaaccgatgcgttacgcgcgaatagcacagttaacacaaaggtcaaatcagtttaatcttcgaacgattcgttatacagaagatgaaattgaaaaaatagctgaggatgaaagttatattcctctttattacacattgcaggacaaatttggagagcatggattggtatcggtattgatattacaagtcaaatcagataaagaggtttttatcgatacttggttaatgagttgtagagtattgaaaagaggaatggaagaatttataattaatgaaatggtggagattgttggaaagaatggatatgaaaaaatatctgccgaatatattccgacatctaaaaataaaatggtagagaaaatatatgaaaaaatgggtttctcttttattggagaaaatcattatgaattatatattaaaaattataaaaaacagaatgtttttattttaaaggaggactaaagatggaaagaaatgaagtgtttgagaaagtaactgaaatttttagagatgtttttgaggatgatgagattattatatcggataatacaacatcagctgatgttgaagaatgggatagcttaactcatttaacgttaattaatgaaattgagatggaatttggaattagatttaagttatcggaagttcaggattctaaaaatgttggagaattggtgacagcattgataaaacatcttgatgaaaagtaggagatgatcaaaatggaaaattggttatattcaaaaaagcatatttggattgaaaaaataggtaatgaggcaaaaataggaatttccgattatgcgcaagaacaattaggaagtattatgtttattaatttaccagatgtaaatgataaacttgaagtaggggctgtatttggtgatgttgaaagtataaagacagtgcatgatctgatatcgcctttaaaaggagaagttcttgagataaatgagagtgtcatagatgatcctagtttaattaacgaatcgccttataaggggtggttgattagagttgctgtggatgaagtggatagcactgttatgacatatgaaaaatatatagaatataaggagtcattatgatatttgatctagctgtaataggtggtggaccagcaggatatacggcggcacttgaagcagtaaaagaaggattgaaagtgattctttttgaaaaaaattatttaggtggtacatgtcttaattgtggatgtgtgcctacaaaatatttattacatagttctgaagtatattcggcacttgatgatttatcattttatggaatttctattgaaaaaagaaaaattaattacgaaaaaacaatacagaacaaaaatgaggttgttaggcagttacgtgaaaatttggaacatttattgaaacaaaacaaaatagaaattatttatggaaatgccgaattaatatctaataatttgattaaatgtaatgatataatatttaaaacgaagtatgtattaattgcgacaggatcggtaccaacaaaatcaattgttgatggatcgttaaatagttcggatattcttagtttgtcgaaaataccaaaatcaatgaatattattggtggtggggttattgctgttgaatttgcacaaatttttaatgatctgggaacaaaagtagaaattcagataagaggaaaaagagttttgaaaaaatggccgaaagatattgcgataggactttctcaagagttgaagaaacgtgggattaatgtgaaaacagattgttcttgggaaaattacaatgtagatagtgcagaagttacaatgtgcgcgatcggaagaagcccttatttagttggattaaatactaagttatttgatatagcaaatgatggcggaattgttgttgatatgtatggaaaaactaaaagcgataatatatatgcggctggagatgtgattgaagatagtagtatgttggcacatgtggctatggaacaggcaagacgtatcgtacggcatattacaggaaaaaagattgcgagcagatcacaagtggttaattgtatttatacaaatccggaaatagctatagtcggaatgacagaaaaagaggctaaagattgtaatatgaatataattactgcaaaacaaacaatgtattcaaatgctagaacaatgattgcttcagcaagaagaggattcataaaattaattgctgatgttgatacaaagaaacttatcggagcacagcttatgtgtgaaagagcaacagatattgttaatgaactttcacttgctattaataatggattaacaattaataatctgattcagtctgtgagaccacatccaagttttgcagaagctgtaacagaggcgttatttctgttggaggaaaaactaaagtgataaaatttaaatatgttataggcaaaagtacgaacccatatgaaaatttggcacttgaaagttatttgatggaggtggtgacagaggggagtgctattatatatttgtggcaaaacgctgatacaattgtagttggtagaaatcagaacgtatatagtgagtgtttatatgaaaaattcataaaaacaggaggaagagttgcaagaagaaaatcgggtgggggtgctgtatatcatgatttgggaaatttaaatttttcaataatttctttaaaaaatgatgttcaggagtgtaaatatcagaatattattacaaaagcattagaacacttggggattaattcagagtataataaaagaaatgatatattagttaacggaaagaaatttagtggaaacgcagaatatattaggcaaaatgtgatttgtcagcatggtaccttattgattcacacggatattgctagaatgacatcatatttaacacctcaaaaaagtaaattagaaagaaatcatgtaaaaagtgtagaaacaagagttatcaatttagaagaagtctctccaaaattatcaatagataaaatgaaaaataatattttagaagtattgaatgcgtcgcctttaaaagattatgaaaatgaagaaaagatactatattataaaaaaatgtattctagaaaggaatggattataggagggaacatatgaaaatattagcaatgtcggatttggttccagaacagatttgtgatattgttcgctttacaaaatattcaggagatcttagaatttcgcattattgtggttatgctgctgattttatatcaatggtgctgaatgaaaaagatattgatggtgctgtttatccaaaaagttgtgatagcagtagaattattggaagctatctagaagattcaaaaaaatttaattatcaaatctgcataccggtatgccggaaaaatattgctataacgtattttgcagaggttttaaaagattataaaaaaaatatagaagaacattatgcaataaaaataaataatatattggacagaacagagaaaattaatttgcgtaatgaaaagttaaaagatatttatagtcaaattgaagaaattagttatagtaattatttaaagagtattcatcaattattggagcaaccattagataggcaggtaattccaaattcatttggaaattcgatacaaagtaagaaaagagtatatttagtaggatcatttttgtcaaatctttcaattgtggatatgattgaaaattgtggaatgaaaattgtgggagataatttgcctgaatcagggcgtttgatttcaactccggatgtaaacttaagtggggatattattttgaacgttgctaggagttcattggaaaaaaggttatctccaacacaaaataatttcaaaaatattatagaaaaagatattaaagaaattgaaagtaagaatgtgaatggtgttatctttataattcaaaagtactgtgaaccttatgattatttattttctgtatatataaaagttttacatgaaatgaatattccagtacttaaattaatacttgcagattcggaagataacagaaaagtgcagcttcaattagaagcatttgctgatgcaatttagtataggaggatataatggctcaatcaatagttagaattcaatcaaaattgatgagggaatattataaaaatttttcaaaatatgcaaaaggcaaaaaatcagagaataaaattgcttgggttacatcttttacgccggtggaaatattagaagcacttggagtattgtattattatccagaaagttatgcggcagtaattgctgcaagtggaaaagagcaggaattacttgaaaaaagcgagaaagtttctttgagttgtgattgttgttcttactcatgttgtatacaaggatgcttggaattagaagaaggaccacgaggagtacctcctaaaccagatattttaattgctacgaataatcagtgcaatacacttcctaattggtggaatattcttgcagatagatataacataccgttgatagtactcgattatccaggggaatctatgggacggcgacaagcttttgaatatgttacacaacagcataaagaattaattgaagatcttgagaaacttacaggtaattatttaaatattgacattttggataaacttatttttaatagtcagatgagtgtcatggagtggaatcatgttatttcacatatggaagatcgtaatgtgtgcccgacaagtttgtttgatggaataaattttttgattacggctagatgcaaagaagatacatctgaattatatagaatgatgaacgaagaaatggaacaggaaccactagcagataaaaatcttatacctatattttggctgggatatccattatggtatcataatgataggtatttgtcttcgttgttaaaagaatgtaggattgtaggatctaattacataacatggtggagtttggattatttagggaaagatgtttatgaaaaattattcaatgcatataattatactttccttaatttaagtcaaaaaacgagaaataaaaaattgaaaagtataatacaaaaatcaggtgcaaaaggggctgtcacattacataataaaagttgtaaatgtgattttgtatctgcaaaagatatttctattcctcaagccgaattagaagttgatatgatagacagacattttgctgatgaaaaaaggattagagagcaaattttgcttcttaaggagactatatgtacaagataggaatagacgttggatctacttttacaaagtattgtatattgaatgaaaaaaaagaaatagaaaaatgttataaggaaagaactcctgtccttcaaaaaaaatattttaaaaatattttgcgacaattacagttaaagtatccggattgcgatataataacttgtggttatggaagggaaaatgtatatgctttaaaatccataaatgaactaacagcgttagcttttggggtgaatcatcagtatgtcgattatgacgtgatattggatataggtgggcaagatataaaaattattagacaggaaaatggacatttgagagaattttttgtaaatgatcgatgtgcagctggaagtgggatgtttcttttaaatacattaactcttttaaataaagattttgataagatatgtttagatgaaaataaaaaaacagatattaagctatcatctgtttgtgcagtgtttgctcaaagtgagattgttgaattgattgccgccaatgtagaaccagatgaaattatacaagctgttattaagcagatatttattcaagccaaaaagcttttgggaaaaatcagaactcaaaagattctgttgactggaggcatgacatcaatagaggggatagaggcatttgcgagaataaatttggggatagaatgcaagtgtgctggaaaggatggaaattatttgtctgcaattggttgtgctttgcagaatcaatagatttttattaatagaaaatgatagataaaaatataaaaaggattattttcctagattatattcgttcattcgctattttgtgtgttttacttacgcatactacagaaagagtatatacattgaatgcaatggcgttagcacaagaatctatgcagaaataaaaggggtctgaccccattaaaaaaatataaacttttttaatggggtactgtttgccgatattatggtatccggagcagatgcatttttgctgcatgttaccactacgacaagtgtggcatatgtagtccgtgatttatctggctaccagatcttacgatgggatgcgcgtggggctggattgttccaacggaagtacgtttaatattgcaaagagtgtgtttgatgcgcttggtaccaaaacatatgtggttggcaatgagccgaacggtaccaacatcaatatgggatgcggatcggtgtattgccgtggatgaaaacggtatggaagtgcatgaggattatatcctgtatgtatgtaggaagtatctgaaggaatgtggccgtctgcagaataatacggtggttgccacgatcatgtccaacatgggattgttcaaagcaatgaagcgggagggcattgagtttgcttttatcatctgcgttcatttgtgcctccttaagtataggataagtatagcaaaaacaggggcgaatgggaaatcggacgaattccgggaccggcagaaaaatgaaagaagcaggaggggaaatccgtattccagccatgtaaaagcaggaaaacatgcaggtactgtttataatttcaaaagaaaaagcaggattcggaagtcgttaacgagacttcccatcctgcttgagtttatccacaaatatatttttttaaatttcgtcagtttttacaatggtctgaacagtaacaggcactgcaaataagggaaacgctgtaaaaaccttcgttgatttttacagcgtctttggctataataaaagatagaatatagtattgattttgaaaggatggtaactatgccaaatatattaccggtatctgatttgagaaattacaatgaagtgttgaagaactgccaggtgggagaacctgtttttcttacgaaaaatggcaggggaagatttgtggtaatggatatagaagattatgagcgagataaagcagaaaagaaacttttagagaagctgcaagaggctgaggcggctgtcaaggatggaaaaggttggttgtcattggatgaactaaagacaatggtgggagaatagaacatgatgaagttacggattaatccgttagtggcaaaggacttgaaatctattaaggattatattgctgaggataatgcagataaagcattggaaacaatacaggagatttacagccagtttgagaatatacagcagtttccttacattggtgtagacttgtctaagcgtgtgagttttaagacggattataagtatgtggtgtggaaagattatgtcgtgctgtataaggttggtaaagaggtagtagagatttatcgggtggtaaatcgttatcgggatattacgggagtgattgaataatttgaatcaaaaaagaaagaggctaacaaggtttactatacattgcagcatgatggttcatttgttaaatctgaggttgaaagtgatttatactctcataataattgttattttgtctctgcgacaagagaacttgatgagagtgaaattaatacacttaaacagaaagccaaactatacgccgttgcagataaagagaaaattaacaaaatatgggatgaattatcaggaaatgtagatatttttgagtatttttatagattgataattttaattagaccaaagcttgaagcagggttgtcccgtgaacagagattagttaatcgttatattagaaaacaattatcgctgttagggaaaaaggaagacgaggtatacaatccgttatttgaagcattgaaaaaagctggaatacctttaaatgaagaagcacaaaaggctcttgaagatgatgaagttgatgtatatgatttagataaatttaatatatgcattgccatgtttagtcgatttaaattggatacaccttattcattggccttttgcttagattggttggatttggcgataatgctggctctggattcccgacaattcttgatgtgtggaagtcagaaggatggataaaaccacaattgatagaagatacaaatcttgatcaggtgacacttgtgatgaagatggaaaaggaatctgatgataaatcagcagaaaaatcagcagaatcagcagaaaaatcagcagatttaaaaaacagggaaggaatgatgttatcagaaagacatcagcagattttagccattatggaggctggtgttgaatatagtacggaacaggtggcagaaaagataggattaaaaggtccaaggacaagacaattattaaacgaattagtgaataaggagttattggcttgtattggaacaactaaaagaagaagatatattaagcctgtggattgaaaaattccagccttattattgctaatgataacgagtataggatagaccatgctttatggcagggataatagagaagttttggaaaagcaaaaggcaagttgtacagattaaaataattcgtcgctttttcattagaaaagcgacgaaaagtttttatcagttcgggcaaaacattactaaatcagcttgtgataatgataaaatagctaatattaattaaattcattcatagcgtccacatattcctgtaatccattaggctacagatattcagataaaaatgtttgatgaccatatagtagttgaaagcccgggaaaacttccgggacttgtaagagcggacaatatacgattcacacatttttcaagaaatcctaagattgcagagtttctaaagaactataaatttgtaaaagaatttggagaaggtgtcaatcgtatgtgtaatgagttggagcaggtgggactaaaagatcctgtttatcatacaaatgcttttatgttgcaggcggttatttataattcaaaagttggaaaaactattgttgaaaaaaccgctgattcattaaaaaaattggctgttgcagtcaataagtcgttgattgattaccaaaagccggcgattggagaagaaaagtcggcgattgacgataaaaaatcggcggttgataagtatgtattcatagaataaaaatgagatatagagttttcctgaatgtaaaagctctatgtgtggaagtcagaagaagataaaaactgaattggttaaaggcacaaatttggtttaagtaactcttataatgaagatggggaatgtcatagaaaatgtcgtagaaatgtcatagaaaatgtcatagaaattttgagaaaaatcaagtggctaaaataagaatattctaagaagaatctttctaaagagtgcgtgattcttaaaatgatttctgaaaaacgaatatttcaaagttagtctcaacgaagtctcacgagatttgagactaagtgagactctatgatatagcaaaatgtgataaaatccggatttacaggtgaattataaagttgtagtctcaagacagtctcatttttgaaattgtttgctgagactaacatgagactgaggagattcaaaatcatggacataagtaaaaaagattggaagctatttcgagaaagattatcaggctggcaggaaaattatatggaaggtcttgttaaagagtatgcaaattttctgaatgatgataaaaagcctgcatcagagaaattttgggaacttgaaaaacggataaaagaagataagcgtcatccaggagttatcatggagatgagtaagtcagaggtaatatgggatatcgttcgtcttataagattgaaagtaattacatatgatgatttatcagacttcagtgatgaattaaagcaggaagtagaaagaatccttgaaatgaagtagaaaataagtatggagattgcagtattcggaaaggaataattatgactttagaaaacaaacttaatattacggattccacggaactggccagaatggaagaaaagataagtaagaagaaggctgttgaattatttgaaaatgaatacctgaatcaatgtgaagttggaacctttcagatgctggcagcgattcataagtacctgtttgatgagatctatgattttgccggaaaaatacgaacggtaaacattgcaaagggtaattttcgatttgcaccagtgatgtatcttaagacagcaattgagaacattgagaaaatgccacagacaacatttgatgaaattattgaaaagtatgttgagatgaatattgcgcatccgttccgggaaggcaatggacgaagcacaagaatatggcttgatttaatattgaaaaaagaattaaacaaggtcattgattggagtactgtagataaagaagattatctacttgcgatggaaagaagcccgattaaagatatcgaaataaaatacattttaaagcaggctttgacggacaaagttgatgatagagaagtgtatatgaaaggcattgatcatagttattattatgaaggttatgctgtgtacaaggcgcaggatttataagtatatccgctgttatgcgcatggatggaatgattaaaaagatatgcaggaacagggagtttgttcctgcatggaaatagctgactggctgtttttcttgtaaagaaataaaaaacaaatgtggagaaacaatatgaattggcaaaaactatttgcatcacatattttagagcggggatatgattattattgtgatggtgcagttgaaaatatagagatcggacgcgatgatatacgagctgatgtcgttggaaccgaggactacgaggttgagatttccttaaatgacgggaaagttacagatatgtactgttcgtgcccctatgctgcaggtggaaataattgtaagcatatggcagcggtgttatatgaatggactgcggatattatggatgaagatgagccagaagatacagacaacgaggacatggacaatgatgcggatgcggaaagcatggatttatttgagcctgcagttaccgtctgtgattataagaaaaaatcagctgctgtggaaaaactggtgacatctgcagaaagggatattgtgcaagcatttcttgtgtctgtcttggcagaagataaaaaattattgcttcgttttcggaatatggtaaacaaatgtgcaacaaaagaagatgtcgaagattattttgaacagattgatgaaatagcggatcgttatctgggaagagatcattttatcaattattatcaggcatatgattttatgttggagctggaagaaatcatagataaagatgtccgtcgcatgattgacaatggaagccacataagtgcgtttcatgtgatgaaccatatttttgtgttgttggggaatgtcgacatggatgattccggtggggaaacaagtatgttggcagagcagatttatcaactgtggttagagttgcttactaaggttaatgcacaggataaaaggaaaatgtttatctggtttaccacgcatatggatggttctgttatcgattatttggaagaatatatcgaacagatcattatggaagaatttaaggaaccggagtacgagcaggataaactttcttttatggaggaaatgattgagaaagcagagaaaaaagattctggttggagcagagattatgcggtaggtaaatggacggtaacatatctgaaaacattagaagagaaaaatgcaccagaggatcagctggaagaaatatgtaaaaaatactggaacaattccggggtaagaagatattacatagacagatattttgaaaaaaaagaatatgatcgtgtgcttcaggtattggatgaaagcatcgaattggacaaagcgtatcgaggtcaggttttagaatatatccagaagaaaaaggagatttatcgtttacagggaaacaaaagtgcgtatatcgaacaactttggaaattagtacttgaacaaagtgcgggagatttagacatttataaagaattgaaagcacaatattcagaaaaggaatggctgataaaacgagaagaactgttcaaaaaacttccgccaaatgcacatatagacagattgtacaaggaagaaaaattatatgaccggttgcttgcatatgtattaaaaagttctggattgtatgcagtgcagtcgtatgaaaatgtcctgaaaaaagaatatccaaagcagattttaagtaaatatcagggtgaagtaaacaagatggcttcatgcaccggaaatcgaaaacattatgcagatctggtagcgttgctgcggagaatgaagcggattaaaggtggatctgagattgtggaaacaattgtcgaagaatggaagataaaatatagaaatcgtccggcgatgatggatgaacttagcaaattataagcgcatgcgactaagaaagataccgttgattttatgcagactaaccagatagatgtaaaggttattgatgtggtatgtaaaatcatagatgaagtttcatttgcagggactgattccgttatgcatggcacgatagaaaaaatggcagaacactgacaaaaagttatggaaaattttcctgatgaatttataagttcatcaaagtagtgaaactcatgcaggaatatgttatactaaaggcagacaaagctggaggatatatggatgagcacctgcaaggcactgttatctaaaattacaaataaaaatgctttttacgagcaggaggatatgacacagaatatttttgcgttccgtgtggtgggaatctgcattttattctattcgtttgtgatgattctgaactgcctgcatatttttatcgtggatcaggcgatttttatcagaggctatgtggtggcatgtgtgctgacgctgatttatggattgctgcttgtgaagatggggcttgagcacccatttaccaagtatctcagcgttacggccatcgggttgatcgtcatggccgcgagtgcatcccttacctaccatatgatcattattatgatgatcccgattatcattgcaagtatgtatacttcaaagagactgtcggtttatgcctttatctttacagtgggtgggattacgatcagtacttatgtgggctattattttggggtatgtgatgcaaacatggcactactgacggtgacatcactggatcatctgcagaaggatggtgtgtttttgctcaacaaagtaaacgaaaatcctatggttacgctggcactttattatgtgatgccgcgatcgctgatggcggttgcattttattatgtaagtaacagtgtaaacagtattgtgcgcaagtccatggaaaatgcaatacgtatggtacaggcggcttccatggatgatatgacgggactttacagcaaaaataaactgcttgaaacagtggaacatatggagccaaaagaacgcccggttgcggttatttattgggatgtcaaccagttgaaatatgtaaacgatacgtttggtcatttgtacggagaccagctgattgccaaaattgcgggatccattcgggcagcagtgacgagtgaggaaaccaatgcttaccgttacggtggggatgaatttcttatgattattccggatgggacacaggagattgcagaagatgtcattgaaaagtggaggcaggtgatgaagccgattcagaaaaacagtgagattccggtatctgcctccgtgggatatgccgtgggaaaatatgaaaatataatggaactgatcgagatcgcagatcagagaatgtataaggacaaacaaatacgccgccagtagcggcgtattttatggctcagagggataacagaaccggaaaggggtagagaaaatttgaaaacaaacaaatatgaaatagatatgtgcaatggttcgatcatggataaactgatctcgtttgcactcccactcatgctgtctggaattttacagctgatgttcaatgcggtggatatcattgttgtggggcattttacgggaaagcaggcactggcggcagtgggatcgaccacggcactcatcaacgtgttcaccaatctgtttatcggaatttcgctgggggctaacgtgcttgcggcacgtttttttgcgtctggcagggaaaaagaaatgtcagacacggtacataccgccattctgctggcactgatcagtggaattctcatggctggaatcggggtaatcagtgcaaaaggtgcgctgcttcttatgggaacgccggacaatgtcattgcacagtcaaccctttacatgcggatttattttctggggatgccgttttttatgctctataattatggggcagcgattctgcgtgcggtgggagataccaagcggccgttgttgtttctggtgatttccggatgtgccaatgcgctgctggatctgattcttgtgatcggttttcatctgggggtggcaggcgtagccactgcgacgattacggcacagatgatctcctgcattctggttttgttatgcctgtaccgcaccgacagctgctatcagctgcgcttttcgaagctgaaaataaaaaaggtttatctgctgcagatttttcaggtgggaattcctgccgggattcaaagtacggttattaacttttcaaacgcgctgctgcagtcttccgtgaattccttcggagatacggcgatggcggggtatacagcggcaaataatattttgggatttttgtatatgtcggtaaattccattacacaggcatgtatgagttttacgagtcagaattatggtgtgggaaaatataaacgtatggatcgtgtgctgatcgactgtctgattcttacggtcagtgttcccctgctgctgggatgtggcgcatggcttttcggaccgcaggtacttagtatatatacgagagaaaaggatgtgatcgagagtggcatggagattcttgccattacaacagtgccgtattttttgtgtggcattatggatttgtttcccggagcactgcgggggatgggacattcggcagtgccgatgatcctgtcggtgatcggtacggtcggaacgagaattctctggatttttggatttttcccacatcacaaatcgttgtacttcctgtttatttcttatccggcatcctggatcatcacgattgtgatgcaggtcatctgtttttattttgtgagaaaaacggtgcgcagggaattgatgcggggataaaacgcagcgtaaaaaatgtgcccaaaaatcggaaacgatttttgggcatttagtttcttgaagaaagaaaaagaacatgctaccatgatggaaactaaaacaaagaaaatagtttccttccggcagaaaggatgaaaagaatgaataaagaactgaaagagaacattatgcagggaacgttgcaggcattcaatcaaaagggtttgaaatttacgatggatgatattgcaaagattttagggatcagtaaaaaaacgatttatcaagtgtttcgtgataaggaggctttgtttctggaaacggtggactatttgtttgaccggatcaaggacagtgagcagaagatcgtagagaatccccaaatggataccctgcaaaagattcacacaatccttggtgtgatgccggaatgttatcaggatgtggattttcgacagttatatcagttaaaagaaaaatatccggagatttatcatcaggtggaagtacggctcgaaacaggctgggaaacgaccattgccctgttggaacagggcatgcaggaaggtgtgattcgtccggtccggattccgattttaaagatgatgctggaagcatcgttagagcagtttttccagcgcgatatcctgctgcagaatgaaattacttatgcgcaggcattgcaggaggttgtcgggattctgatgtatggaattgcttcggagaggtaaaacgaaaggggagcataaagaagcatggagaggttgtattggaacaatgactggaaatttgccgaaacatgggaagaagccatgaaagaggcagtatatccggaaaatgagatggaggatgtgcggctgccgcatacctgcaaagagcttccgtatcattactttgatgagcatgcgtatcagatgctgtgtggatatcgcagacattttatggcgccggaagcgtggcaggggaaaagtgtggaactgacctttgagggagtggcgcatgatgtggttgtttatgtcaatgggacagaagtgaaagcgcaccattgcggttatacggcattttttgtggaaattgcaaaatacctgaaatatggggaggacaatgtacttgcggtgcgtgtcgacagccgggaaaatttgaatattccgccgttcggatatgccatagattacatgacttttggcgggatgtatcgtgaggtttatgtgcaggtgagaaataagacacatcttgcagatgtatttgtcaagccacagatacatcctctgcaggtgactacagagattacggtacagaatatttcggatgggataacgttgcagcaggaaatccgcaaaaaaggcgagggtgcatatagtcccctgggaaaaaagccggtaaaacagacaaatgtgcaaaccgtttttccagtgcaggagatccgtttgtgggaaccggaaaatccatatttgtatgaaatccgtacgagtttgtggaaaaatggggaaatgatagatgcgcgtgtggatatcacagggtttcgggaggccggattccgaaaagatggtttttatctgaacggaaagaaactgcggcttcgagggttaaaccgtcatcagagttatccgtatgtgggatatgcagcgccggcatccatgcagattttcgatgccgatattctcaaaaaagaacttggcgtgaatgctgtgcgcacttcccattatccgcagtcgcaggattttatccgtcgttgtgatgaaattggcctgcttgtgtttaccgagtttccggggtggcagcacatcggggatgaagaatggaagcggcaggcggtgcagaatttaagggaaatgatcgtgcagtaccgcaatcatccttccattattctctggggtgtgcggattaatgagtcgcaggatgacgatgttttttacagggaaacaaaccgggtggcacatgaactggacgatacacgtgcaaccggcggagtgcggatgctaaagaaaagccatcttctggaggatgtttatacgtacaacgattttcttcacgatggcagacatccggggtgtaatccgaaacgaaaagttacaccagatatgaaaaaaccgtatctgatcagtgagtataacgggcatatgtttccgaccaagccgtttgacgatgaggaacaccggacggagcatgcaatccgtcatgcaaatgtattaaatgcggtggcacaggagccggatattgcaggaagttttggctggtgtatgtttgactataatacgcacaaggattttggcagtggtgaccggatctgttaccatggcgtgatggatatgttccgcaacccgaaacttgcggcggcggtgtatagcagtcagcaggaagatacaccggttttagaactgagttcttcgatggatatcggagagcatccgggcggaaaccgcagcggaaactggatgattacaaatgcggatgccgtgcggatgtacaaaaactctaaattaatcaaagagtatcatcgggaggactccccatatcgtgcactggcgcatggaccgattcctgtgaatgactttatcggaaatgcgattgtcgaaaatgagccgatgaaaccgaaacaggccagactgatagggcagctgcttaacatgacggcgtattacgggctgaacaatcttccggcaaagttctaccttctggcattgcgactgatggtctgctatcacatgaaaccaaaggatgcggttgcgctttacacacgttatgtcggggactgggggacgacttccacggtctataagtttgaggctgtcagggacggaaaagtggtaaagaccgtgatcaaggagccgatgcagcaggcacatctggaggtgaaggtaagtgaacataacctgaccgaaggcagaacctatgatatggcggcggttcgtatccgggcactggatgaaaatggaaatgtgctgggatttttcaatgaaccggtgcagtttgaagtgaaaggtgttctggaactgatcggtccaaagaccatatgtttacagggaggtatgggcggtacttatgtaaagacgaccggacaggccggagaaggaattttgacaattgaaaatgcgcagacggggaaaatctgtgaacattttcaggtggcacgggaagagtaagggggaaatacaatgaaattatcagcaaaagaaaaaacggcattcggcctgggggcggtcggaaaagatatggtatatatgctttcggcgagctatattctgtattattaccaggatgttctcggagtaagtgcgatggcaatgggaattattctcatggcagcgcgggtgtttgatgcatttaacgatccgattatgggagtgattgttgcaaaaaccagaacacgctggggaaaattccgtccatggcttctggttggaaccctgtgcaatgcgatcgtgctgtatctgatgtttgccgcaccgccggcatggaatggaagtgggattgtggcatatgcagccattacctatattgtgtggggagtcacctataccatgatggacattcctttctggtcgatgattccggcatttacagaaggtggaaaagagcgcgaaaatttaacaactatggcgcgttcctgttcgggtgtcggttccgctctcgttacgattattacgatgaaatgtgtgtatatgctgggacagggaaatgagcgcacgggtttccgctggtttgcacttattgttgcggtattgtttgtgctgtttattacgatcacctgtctgacgatccgggaaaaatccacggttcatatggaaacaccgaccgtacggcagatgttttcggcgctgattcacaacgatcaggcaatgacggttgtcatcaccattgtactgattaactgctctttgtatattacgtccaatctgctgttgtattttttcaagtatgatgtgagtggggagagctggtataacagctatacacttttcagtacatttggcggagcggtacagattttgtccatgatggtattgtttccgctgctgcggaagtttatgagcagtatccgtgtgttctacctgagctttggaatggcaatcgcagggtatgcgattctgcttgtgctgatgattggcggtcatactgtgcttggagccctgatggtgccgggctttttgatttttgcggcatttggcatgctgactgtgcttaccacggtatttctggcaaatacggtagattatggggaaatgaaaaatcaccgccgtgatgaaagtgtgattttttccatgcagacgtttgttgtgaaactggcttcgggagttgccgtgctgatcgcagcgatctgtctgtctctctgtaacctcaagcaggatacaagtgcggcggttgttgcgcgtgcagcggattcttcggtgctgggactgcggctgacgatggcgggaattccgatgatcggtcttttcatcgcggtattggtatttcggaaaaaatatattttgacagagaaaaagctgcaggagattaatgcagcaattaaaaatcaggagaactgctaaaagaaaggatgacagctatgattcgtaaaattggacaggcattcgtactggatacggcacatacaacatatgcattttccattctgccggggggacatccggagcatctgtattacgggagaacgattcatatcgagcatccggatgatcttgaaattcttgtggaaaagcatgtgtttgcaccgggaaatgtgaatatctgtgaaaaagagcatgccggtttttcgctggaggatgtgcggctggaaatgtcttcgtacggaaagggcgatatccgtgagccgtttgttgaggccattctttatgatggggcaaagactctggatttccgctatgaagatgccgttattaccgggaaaaaagatgcgctggacggacttccgggttcctatggaagtgcgggagaagtgcagcagctgtgtgtgacaatggtggaccggcagtatgatctgaagctgttgctctactactatgtctatgaggcggcagatgtgatcggacggagtgcgaagatcgtcaatgccagcagtcaggatgtacagcttacgcgtctgatgagtctgcagctggattttgatgacagtgattatatttttacgacatttcgcggcgcatgggcgcgggagatgcaccgctgtgaccagacgctgaccggtggcagaattgtcaatgattcttttaccggaaccacgtcgagccgggcaaattcgtttgtgatgctgagccgtccgaaaacgggagaagatcagggagactgttacggatttcatctgatctacagtggaaatcactgtgagactgcggaggtcagcagttttggaaaactccggcttcttacggggatcaatccacgggaattttcgtggaaactggagccgggagcacagtttcaggcaccggaggcctttatgacctatgcgccggatggatggggaggcatgagccggcggatgcatgcgtttatccgggagcatatcgtgcgcggatattggaaaaacaggccgcgcccggtacttttaaacagctgggaggcctgctattttgatatcagtgagagcaggctcttaaagctggcaaaggtgggaaaagatgtcggaatcgaattgtttgtggtggatgacggctggtttggcagacgaaacgatgacacttcttcgttgggagactgggtgccgaatacaaaaaaactgcccggcggcttatcgcgcctagcaaaaaaaattacagatctggggcttgcttttggaatctgggtagagccggagatggtcagtgtggacagtgacctttaccggaagcatccggactggaccattgaaattcccggaaaaccacatgcagagggacgaaaccagagaattctggatcttggcaggagagaagtgcaggagtatatcattgccagtatgacaaaggtcttttcttcggcaccggtttcttatgtgaagtgggatatgaaccggacgttttccgattattattcacagagcctgccggccgcacagcagggagaggtggcacatcgttatgttctgggactgtaccggtgcatggaggaactgacccgtcgttttccggaaattttatttgaagggtgtgcagcaggcggaaaccgttttgatcccggcattttgtgctattttccgcagatctggggaagcgatgacacagatgcctgttgcagggcggacatacagacaaattacagttacgggtatccgctctcgacggtgagtgcacatgtatctgcgtgtccgaaccatcagacgctgcgccggacaccgcttacgacccgctttgcagttgccgcattcgcagtgctggggtatgaatgtaatttctgtgactgtaccagagaggaacttgaggagatcagggctcagattgcactgtacaggaagtggcgtagtgtattgcagcagggcatattttatcgtgggcggacatttgctgacggaaatctcacagaatggacctgtgtttcagaagatcagacacaggcagtcggcatgctgatgcagaaacttgcggaaccgaatacacagtttcatgcgtattatcccaaaggacttgcaaaagagaaacggtaccattttaccaaccgcgcgttaacgtacagtattctggagtttggggatctggtcaacacggttgctccggtacatatccgcccggattccgtgacacatcatctgctggcaaaatttgtaaagatggatggggaaacggaggatttctgtgcatacggggatgctctgatgtatggaggtgtacatttgcacccggcattcggaggcaccggatatgatgagaacgtacggtattttccggattttgcgtctcgtttgtatctgatggattgcaatttatagccgaaaagtgctatgatacaaaagagcaattcaggcaggacaggagataagaaaatgcagaaacgaaaaaacagatggtacatagccgttgcagcagttgtaattttagcagttgttctggtattggcagttgtgctggggaaaaagggaaagaacaaaaaagatccaaagatgattgagccgacgcagcaggagcaggcatcggaaataccgacggaaacagaggaagtatttgattattccgctacggagaccgcagagacaaaatcgcttccgaagtccgttgtcagcaagcagggaattctcattgatgtggatgccggaacgattctggccggaaaagatgcattgaaacgtatggttccggcatctatgaccaaaatctttaccgtgctggtagcagcggaaaatattaagccggagcagctggacgagctggttaccatcagtattgatgccacagatttcagttatagtaatgactgcagcaataccggatacgaagtggatgagcaggtaacggtaagggatctgttttatggaaccattttgccatcaggggcagattctgcggtctctctggcaacttatgtggccggttcacaggaagcatttgtggatatgatgaatcaggaactggaaaaaatgggattgtcggagaccacacattttaccaactgtgtcggcatatacaatgatgaccattacagtacgccgtatgatatggcaatgattttaaaagccgcaatggacaatgatctgtgcagggaagttcttggaacgcgaacctacacgacatcaaaatccaaaccacatccggatgggattacaatatccaactggtttttgcggagaattgaagataaggatacacacagtgaaattatcggggcaaagacaggctttgtgaatcagtccggaagctgtgcggcaagtatggcacagacaccggatggaaaagagtatatctgtgtgactgcagggtccaccagcagctggcgctgtatctatgatcatgtggatatttacgatgcgtttctgccggagacggcacagccttttgaaggtgaagaggtaacacaataaaaaaggaacagcgaaagctgttccctgttgtttaaagaatgatgatattggcacaattgatatcttctccaaggttgtaaacgttaccgctggtaagcccgacaaccacaggacggagaatatagtgcggaatatttttgaccacacgcgcctgttcgccgttactcagttccacgatgctgtctaccggatatagaatcatgctttcaaggaagctcttcatggcagttatgtcgagttccatggtcatggacataatcatttccacggcatctctctgggaataggcttttttataggggcgttcggtaaccagggcatcatagatatccgctacggacagaatcttggcataggggcagattttctccgcagacacacccatcgggtatccgcttccattgatcttttcatggtgttgcaaaacaccaaggcagacagccggagaaaattccgcacgatccttgatcatgttgtaactgtatgtcgagtgctgccgcataatggcaaattcatcatcatcaagtttgctcggtttgtttaagatagcatttggaattttggtttttccaatgtcgtgcagcaaaccacagacaccgatttcccgtacttcttcgggagagagtccctgctgcttggcaacgatcatggaaatggttgctacatccacgctgtgtttgaaggtgtattcgtcactggttttgagtgtagagatatcaattgcgatggcatcattgcttttaatggaacgcatcaggtcatcggcaatgctctctgtggtggcaaccatttcctcggaggttgtattgttgtagataaactggataccggtagagacacgttcacggatactggcagaaagagtaacttttgcgcggtcttcggtacggagccgttcgatatttttttctgcttccggagaagtaggaacctgttctggattttcctcttcttccccctcctggatgtaaacagacataatacccagtttcaacagggaatcaatcatataatcatccagttcggcacctctggcaacgagattacgtcccagacggtcaacgaccggatgatcgagcttcatgcccggttttaattgtcttgttctcatgtactttcgttttatcatatttatattttactatttgttggatattttgccaagtttttttggaaaactttaggagaactttaggagaaatgatatgcttccacaactttttttagatcgaatgaaacaaatgctggaggaagaatacccggcatttctaaacagttacgaagatgcgcgttatcaggcactgcggatcaatccgtcaaaaaccgacacagaccggtttacagaggagacttcctttcacctgcagccggtgccatgggaagcgaacgggttttattacgaaaaggaagatcagccgggaaaacatccgtatcacgaggcgggcgtgtactatattcaggagccgagtgccatggcaccggctgcatatctggatgcgcagccgggcgaaaaagttctggatttatgtgcggcaccggggggcaaaagtacacagattgcggcagcgatgcaggggaaagggctccttgtcagcaatgagattcatccggcgcgggcaaagattctttccgagaatatggaacggatgggtgtaaaaaatgtgatggtgacaaacgagagtccgcagacacttgcgggaatgtttacggaatattttgaccggatcatggtagatgctccgtgttccggggaaggaatgtttcgcaaaaatgaacaggcgtgtgaggagtggagtcctgaaaatgttcagatctgtgcggcgcggcagcaggaaattcttgcatgtgcggcctccatgctccggccgggaggacgtatggtttactctacctgtacctttgcaccggaggaaaacgagggaacgatcagccgttttctggaacagcatccgcagtttcatattgtgccggtgaaaaaatatccgggaatggcagacggtgtagcggcatggacaaaacatccggcagcggagataggagatacgatccggttatttccgcatcatctgcatggagagggacatttcgttgcggttctggaaaaagagggaaccgtttcggaaaattaccggggatattgtgcgaatggagaagaaaaaccgctggcaaagggagaatcaaaagcgtatcttgcaggattacaggaggttcttggaaagataccggcagatgatgccgggcggctgcttctttttggagagcagctgtatctgatgccggaacatatgccggcaaccagacggctgcatgtgctgcgtccgggcctgcatttaggtacggttaaaaagaaccggctggaaccggcacacgcactggcacttgcaatttctccgctggaagcatgccacagctggaatctgtctgtagatgaagcacgcgcgtatctgtctgggcagacgtttccggcagaaggggagaagggctggtatctgatcacggtagatggatacagtctcggctggggtaaacttgcgggttctgtgatgaagaatcattacccgaaggggctgcggaagctgctctaaaagaagtctgattattgttttaaggttatgattgtgtgaaaagtagcggaatccgtatcatagtacatttgcatgtccccctgatattgtttcactacttttcggatacttttgattccaaagccgtgtctggttttatccggtttatttgaaatcggataaccatcgggatcacatttgggcatgattcggcaggagttgatcaaaacaagcacaacaaaaggcaggggttcttttttttgtgctgtaagttctataaaggaatcaggaatgtgctctgccgcttctactgcattgtccagtaaattgcagaaaagagaagtcaggtcattctggtgcagatgtacaaacgcgttgcttcggatgtccgcgtgaaaatcaatacctttttctttacattgccgctgataacgaccgagaattgcattcagcattgcatcgtcacagatacgggaggtttcctttaagtcagaaccgttcataagactttgaatataggcagttattttttcattttttcctttttcgtttaaaagttcaatggattgtaaatgtttttttaaatcatgaatgagaatattctggttctcatattgagacaacagcatttcataatattctgcagtatctgcttctttttgaagcatcaattgcatttctgtaaattcccgactttttttctgattgtactgatcaattccaaacaccagcaggttgcttaatagaagcaaaacagcacagaacgttaccataattgtagccggaaaaaccaaagaaattgtctcttcaatgactaaaaaagtaaacatcacaaaaatcgaagaaattgggattaatagcaggaatagacacgaacggtcaaaggtttcctgttttgtgctttttgattttaaaaaagccgttaaaatatacacgatggaaaaaaacatccctttgctgatgatgccgtaaaagacaagaccaagagcgtccgccccgggaaaatgagggaataattttacaatgagaccagtaggagccagttctgacatcgccataattgcagtcagtataagggcatgaaaaaatgccagtgggagtgtaagtttaaattgtataaaaagaaaaaggatgtttgccacacaaaaaaggagcagattcagatacggctgctgcaataaagaaaacaaaaacaggagaaaatataaggtaccaagcatcagaacccgtgagagggcagaacgtttggaaagaaaaagatttccagtatacagccatgtgatcatagactcaataaaaaaactgaaaaataagattagaatatgttccatgtgttttacctcgtactttcaagatataaaaaataagcatttttaaatgcactgtattttcttcgcgtcagataggcagtgagctgttggtcggtcagatgtaccgttgtatggtcaaaatcagttacatgcttaaaattaacgatgaagctgcggtgtgtctggaaaaaacagtttttgggaagcagttctacccagtaattcatattctgaacagaaacaaaattctgagaggtggtatgaacaatgacctttcgtccctgcgcttctactgcaataatttgcgaggcaggaaaaatataggtcatttgtttggtttcaatcggaattttgacagttatggcattaaaataaaccagagcatctttcatattccgaaaaaaacggctgagatcaagtggtttggaaagataacgaaatacatgaaaacgcatggcatcatccagatattccgcgtatgaggttaccacaaaaatgagaatgtttttgttttgcttttttaattcatttcctacataaataccgtttacaccaggcatttcgatatccagaaaaacaagatctttctcaccgttgtcggcaagtaaatcttctccacaggaaaaagatacgatttccgggcatttgatatggtgatgttcaaaatagaattgaatataattatgtaattgttcgaccatcagaggatcgtcatcacagattaaaatacgcatggttcatccgtcttcctattaaaataatttctatatattatatcactttgaaaaatttaatacaaaaatatgtgtatgaaaagacaggtttatgtcagttttggtcgaaaataggaaaaatatacaaaaaatacagaagtattctgtccagaccgtagacaaagtgctccgagaaacttccgtttctcggagcatttttcttttggattgtgcttttcctttcgttttttgttccaactaattagccatgaactgcttgatgccctgtgattttgcaccgggattatcgtttccatatccttcgagaagattgataactccccacacgccgacacctgctccgattgcggttactactgttttaagtcctgttactgatgttgtaaaaaagcccatttgtttgtctcctttttcttgaaaaatgaaataaaaaagggagctgttctgatttgtgatttttcagaaaaactcccataacaatagttccaatatttagttgtaaagtcacttctggacattgtgaccagaagttaagccgtgatctctccgacatcgcatacctcgtccaccacatcattctgcttgaaccgcagcttgttaaggtttttaacgtatttttcaatgtcaaattcattctttttgtcataatcggataacatcgggtattgcttatgcttcgttatatcaaacttatctgagaaaaatggtctcacacctctaagctgcatgatacatttgctgccatccatgactgcaatctcgtcctgactcattaactcctttccagtcttttgataattcagaccgtaggactggctcgtacctcttgtatccgagatattgtaaaggtcaatcgtttcttttccaaggatttctgccagatctttcagagtatctttctcttttcctcccagaaacagggtagtgtcgcagtttccttcaatcgtggaagcgttgtcccggtacagagcctttagctgtgactttgactgcaaaataatagaagctgatatttcccggctacgaatggtagcaatcagcttctcaaactgcggaatctgcccaatgttcgcaaactcgtccagtaaacaccggacgtgaatcggcagtctcccattatatacatcatctgccttgtcacaaagcagattgaataactgcgaatacatgatacttacaatgaaattgaatgttgcatcggtatccgagataatgacaaacaatgctgtctttttctctcccaacgtatcaagctccagttcatcataagaagtcaggtcacgcagctccttaatatcaaatggtgccaacctcgcaccacagctaatcagaattgattttgctgtctttccagagacaaattgtcaaggactttttcatcaaattcacaaaaaatctaaaaaaggtgtcagaagcactgtagggctcctgacacctcgtttgatagattacatttttccgttcagcaggtctttgcagagatacgcatagtctggcagctggttgatatatggctcccagcgccgcttgatttcggccaattccagcggatcggctgcttccagcgcgtgatcgttgcccgtcatatataaaacatccgtagctacatcgtccaaacacctgtaacagagatcggcggcagattcgattctgataccggtatccacatagactggatttacgccaatcgccagccagacatagcctaccttgtccgaccagagcagttcaaaatcagggctttgccgcagatgttccgcaaagacctcctttactcgctcaatttcatgcttctctttttctgtgtaaagcattttcgtgtcctccttgacaaaaattttggtgcgtaccatcatcagtttagcacaagacggcttcgtttatcagtctgtcacatctgctgaatttcatttttgagcatacgcttgattttatcactcatggtttctgtgctggtattgctgaaatggacatgaaccttgtaggtcgtcttgccgattttctttaccatcgccgccgtgttttccggcgctctggacgcagtagcggcgtctgccacctgcatagtacggggttctttgttcatggcgctcctttctccgaacgggtctgtgccgcccggtaaaaaatcagtcgtgcttactgtttacaatgtctttcgccgcctgcttggtggccccggcgttttcctcccggaagtttttcccggcaaagaggatcggggcgcaccgttctaggatacggtcatagatacgagcgtgggccaggtcaggcgggtttttgagttcggccagcttcaggttggtggtgatgatcatgggcctgcggctgcggtagcggctgtcaatgacgaaaaacatctgctccatcgcatactcggtactgcgctccacacccaaatcgtcaatgataagcaggtcgtactcgtcaaagctggcgataaagtcggccctgtcctcggaaaacatccccgtcaggcggttcaggatggtgggaaagttcgtcatcagcaccggcacatcccggtcaagcagggcgttggcaatacaaccggcgaaaaaggacttgccggttcccacatctccaaacagcaaaagcccgatattgctcttatatgcctccttccagttctccacataggcgcgggccttgtccatcaatgggttttggccgttgtcgttggcaaaggtgtagtcatagagatagcggtcttgcaagccctgtgcctttcggcgtttgatacgctccatgcggcgctgccgttcctcggcggctttgcactgttcctcggcctcccgctggcactggcagatacagcggggcatgaagtagcctggttttccaaagcatgacacaacggtctgcctctggccgccgcacttcttacagtgaatgagaccgtctgacggatctatatactcgtcctcagccagttccgcaccagcagctgccttgtcgatgaacgcccggatttctgcggtaatctcaatcatacagtttcatcctcctttacgctgtaatcccggttgcgtgagggtgtgatcgtttttttagcgtcctcaccggcccagcgccggatggtggcggcatgactctgataccgcttgccggtagaagccatgtactcggacagcttttcgatgtactggccccatacagtgggaaagctggcctgtaagtctgccagttccccgtccgtcaggaaaacattctggtaacggccataggcggggtgtcccttctctatctctctctttatctctatctctatctctttctctaactctatctctatctctggtggacgaatgtcggacaaatgtccgccgtttgtccggggcgcagaaagagacttattttggagcctcgcagcccgctttcgctcagcctcggtagaggactggccgattaaaagttcgatgttgctcatgtagaatgtgccgctgtccagcacttccacaagacccagcttcaaaaagatctgcaaggctctctccacagtgccgatctgctggcgggtaatggtggcgatcatctgcgccgtgtaaggaatgtcctcgtcaagctggagccgtccaccatgtttcagcgatttcagatacagcttgagcagaatgttggaatacagcacaccatcctgcatactttccagcagcacgatggaatcatcgtcaaaatagttttctttgagtttcaggtaataatattttcggttgtctgacatagggttcctccttggggtttctcttgggattctgtacgcattttaagaccgttttagggggcggaagataaatctatcagcctgcctttgacaccctcgaaaaaatccttgatttacaagggtttttcagcccctaaagcgtgacatttctcccgttgtttccgcttgcgctttgcggcgttgatccgcttcatgcgtgcggcacattccgggcagtatttggcccggttggaaccgggggtaaacagcgccccacatacggcgcatttctttgcattcagccggtggaacagcgccgtttccagttccttatcctgcggcaataccgccgcccgaaaccacctgcacaacagggagtaggaaatagactggacacagacacattcctccccatcgtccagggcgatacagtttccgtcgatgtagttacagcactcatgcaccagcctccgcactctgcggtactggcggtaatccatgacggggataggttcagacttattgttcttcataaatgatttctttcataaagttggtaacctccttaaatgaatttattgttaaatattcgtgcaaagtattgttttcttcgtgcaaatggcatatactataattgccagcagaaaggggttgatcgtatggctggaaataccacaaacatcagtatccgcatggacgcagatttgaaagcgcaggcggacgcactgtttactgaacttggcatgaacctgactacggcgtttaacatctttgtgcgccagtcgcttcgtgaaggcggcattccctttgaagtaaggctggaacagccgaacaaggaaacggttgctgccatgctggaagcggaaaggattgcaaaagacccgtctgtaaagggctacaatgaccttgacgagttgtttgctgacctgaaaagatgaaagaaaccaaatataccgtcaagtacacgaccagtttcaaaaaagactacaaacgagccatcaagcgtggtttgaagatcgagctgctggagcaggtcgtagcgttgctggctatgggcgaaccgctgccggataagaaccgtgaccatgacctgtccggcgattgggcaggccatcgggaatgtcatattctcccggactggctgcttgtctaccgcatagaagatgatgttctggtgctgacgctggcccgcaccggcacacacagcgacttgttcggcaaataaaccgactgccgccgtatggggaaacctgtacggcggtttttctgtgtgcaaaagggtgtcgtgaaacgcgacgcacctaaaaggagtacgccaaaacgcggtagcccttaccgctccggttcccggtcgtgaggtttgtcccgttcctgtcgggacaactgctcggcggttttgcggagccgttccactgctttcaaatcctcccgcattgatttcatggcaagcgtatccgtctgctttccggcggtcagctggtcgatttcccgctgccatgccttcggggtgattgcctcgccgttgtctttcagttctttcagataccggtctgctgcgtcatagaggatcagttcccggctgtggcgctgttcaaactgttcccgtttttccggctttactttggcaagctgcttgtggatggacttgtactggttgtactgttcccacatctccccgcgctcggtaagggtagtgatccggcgctcggccttgacgatctttccgcgcaggtcatagtaacggctgttcatatcagcgattttttcatgaagctgctgcatagactggatgccgtttgcctgcaaaaagctgaatagtgcagcgctttcttgcaaagcccggattttgccggtgcgggtgcggggagcgtccaactgctgctgggcctcccacaaggcggtcaagctgctttgctgtgtttgtggtttttccgtttcggctttcgaccagcgataaagacgggtaatgcgggctttgatttctttcagcagcttgttgtcggcggcgatctgccggtttacttctcccttgtcggtgcggataccgcgcttttccatttggctggcggctggccccagatggacagaggggattttatcaatgccctgccgcttgtagctgcggtggtcaatgcgctccggtctaccggcagattccagcgcccggttggtgtaggctgcccacgctgccctccaaatctccacattccctttgtcgttccagtcggtggtgtcctctcggtggttcttccagccgcctttcccatccgggatacgctgtccattctcgtccaggtcgtatgccttgcggcacttcgcgccccatgcgccgttttcttttaagggccggacggtcagcatgatatgaacatgggggttgccggttcccctgtcatggatggcaaagtcggcgcacatccccttgtccacaaagttgtccttcacataggaccggacaagggcaagctgctgttctatggacagttcgcggggcaaagctgcctcaatctcgcgggcaagctggctgtcccttgctttctcgatttgctccacgctgttccagaggatagaacggtctgcaaattccggcggggcgtaggcaggtagcatgatctccgcatgaacaatgccgcctttccgggtgtagtcgtgggtcatgccgtcccattcatttgtcagcttggttccgctgcggtaagcagctgcggcaacagcagaacggcctgcgctgcgcttgatgatactgatggggatatgacagaaatctatggggaacacctcctttcagtgaggggataacaggctctgtggagccggacaaacgcaaagtgggtgtctggctgcgcagagcgcacaaggggtttggggagcgtagcttcccatcgtggacgaagtacgcaacgcccccggcagggcgcacagcaccggcaacggtgtataagtgcgcccttgtaaacaagggacttatggcgtgtccccggattttggcaggtttgcagtcaattccgcagcccccggaagatgggacagggcaatcagaaatgctttgacctccgcgccggaaaggtcgggagccaacgggaaaatcccctccaaaacggctccacgctcaatcaggcggcgggtgcgaaccctgcgttcttcgttccgctgcttgttctccaaaatcttctttcggttttcaagctgccgaatctccttcaggactttctcccgtttttctttttgggggtgggctgtaattttttcgttcatgtcaggcacctcttttctttggaaatactcatagattgaccgtccatttctgtcgagcaaagtaccggcgcagcctccgcagtgcggcatggatggattttcccgcctgtgatggcgtgataccctccattgcggcaatatctttcactttcatacccagcatatagcgggcatggacacggcgagcctgcataggcggcagggaagaaatggcttcgtacaatcgccgtatcagttcttcgtattcggctaattcttctttttctatcaggtagtcctccggcgatggctgcgcccagccgatggcggcattttcgattccatcgttacaatcgagggaataaaacgccttataccggaacatcttgcgatctctggcgccctcggctctcttgtccagaagaaacgcttcgacgatctcatcggacacctccacaaaaatgtcctctttgcaaaatggataatattgtttgagatttatggtctgcataggcacgccctcactctgtttgaaaaaggtcatcatagcagcggcgcatattccgcagcccccggtggatggcaacgctgaccttactgctatggataccctctctccgggcgatttccggctgcttgataccggcaatgtagtaggcgtgaacacggcgggcctgtgtcggagtggcatgagccagagccgcaggcagagctgcaatcaggtgcaggcgggtggtcatttcttctcgttccagcaaaatatcttccgacgatctgctgtgttccagtgcgtaattttccagccagctgtatgcgtccagagagtagtaggcgcggtggtagactttccgacgctcatagttctccatctcccgctgggcctgatacatcgctgcccatacctcgtccgtaacatccacaaactcgtcatgccggtagtggggatacatccaccgcagattgattgttttcataggcttacctcctgaaaattggagaggcgggcagctcgtccgctgtccgcccctcgctgagataagggaaatgatccctttcacttggtagccagaaaacaggtcatttgttaagcctgttcccaaagaaatttataaatttttttctgaccgcctccacactttgatacacagccactttggagcagccgcacagcacaccgatctctgcaaggctcagcccgtcaagcgcatagagcaggaaccggcggcgctgggcctcggtacaggtgtcaagaacagccatcagctcatgcagtgtttccttacggcaaaggtattcttccggcgtttctccgtaggctcctacgccttcggtggtaatgatgtactcgtcaaactcccggccatcccaatgccgccgctgctcatggaacaggttctccgttttgtgatcggcccggtcaagaaattcatagacttccagcgtaacctccacggccacagcttgtccgttataattgatggtaacttccatctgcctttcctccattcagatttttttggtaaatctgaatgaggcggcggggagcggcaccggggataaagttcgggccatgctgacccgatgttccggctccacagggacaaaaaagcgcccggacggcataaagccatacgagcgtaatggaatatattttgctgtttggttacatggtatagtgcatactgctggtcgcattgctccgctgctggaaacaggctttttttagctggtgcaggtcatgggtactgtgaaaaaagacaagaatagacacggcggcaatcctcctatatgccgccgtggatttacacggtgttaggtcgtcgttggtttaggatagacgaaaagaaacggcggctctgatttctcaaaaccgccgccagggtatctagagtaagcgcacaaaatcaacctgcccagctacggtttttttctttccccattaggcggggcaggtttaaaagaatatgaaaagccgataacagcagtcatgttagcctgcgtgttatcggctctgcgtctatgcgtctggctctctaataacggatatattcagttgctttacatgaatgagcgtttcctgtttacattttggacagaacaaggggaaattccttaattccgtgtcaattcgtatttttattcgggttttattatggcatataggacaactaacccaacttgtctctttcatcaaaattaccccgtaacttgatgtttctttgatatattttttgttagtctataaaatacgaatatcaatccaacattaaggatgatcataaagaccggctggctcataccgaaatatgttttcatatcagaaaatataccgtttgtatgaagcataaaaatcgggcaaatttcctgcattttttgtaaaacaggaaggctatcattaaaatcaaacacaactggcaagaagcagatgacgcaagaagtaataagcgctgtaacaggagaactcatttgagcacttaaaaacaatgtaatagttgtcaaggctacaatcccaaaaatattcaatattacagagataaagaacatttgcaaaaaggtcaaattatatattgaagaagcataatgtaatgaagattgaatgcttacattccacccctgtaacccataggtacagccatacagaactaaatttagcagtaaatacaagaggtatgtgccaattacaacttccaaggccgctataatttttgaagttgtgagtttggttcggccataccgagccgaataaataatgctatctgtatgaagtgcatactcttctgagaaaacaggagatagagtgattacaacaattaaacatatcattatggacaagatgctccccattccagataatagcttatcccagccatcgcaatatcctaaagtcacagttggactatttggatatgctgtttcgagtgacttaaaactaccatcagaatttgtcaaatattccagaatcgccgcttggtcacgataaacatgaacagcagaaaaagcagaattttcatcttgtccaacagttgcttgttttgcttggtcgattttttcttgcatagtaagtaatgtattttgagagagttttccttcaaatatttctgctacttccttccgttgttcaatggctgtaaaaccgcttgctaatgccattttttcaaggtcataatcatagaaaacattttgataattaaattgaaaaaagaaaaaataggcaacgataagaaccacaccagctaaaaacaacattcgtgtttgctttctcgaacatattttatttcgttctgcttttatcatttcattcatgctcggatacctccgcaaaatagtataaatacaaatcttccaatgttggatcaacattccaagcggttctgcatggtgcttcttgagaaataatcctcagccgttctgcaccattattatgtttcagatttgctgttacatagttcaattctaattcttcggcctcttttcgagatacatcacattcccaaacacatttttcaatcggcttcaaaagtttttctggagaaccatgttgaattaactcgccatttttcataatcagaatctcatttgcgatatattcaacatcagaaacaatgtgagtggacaaaattacaattctattttctgccaaagaactaatcagattcctaaaccgcacccgctctttcgggtcaagtccagctgtaggttcatccaaaatcaaaatacggggatcgtttagtaatgcttgagcaattcccaagcgttgtttcataccgccggaaaaagttttgattttttcgtttttctgtgtgagcagatcaacaacctgcaacagctccattgtgcgattatgggcttttttaggtggcagcccctttattgcagagatatacatcaaaaatttatacgctgtaaagttaggataatagccaaaattttgtggcaggtagcctaagatattacgatatttctcgcccaaatcatgaatgtttttcccgttaaaaaaaatggctcctttcgtttcagtttggacatcgcaaatcattcgcatcaaagttgtcttgcccgcaccatttgccccgagtagaccataaacaccatttgttaattttacgctgaaatgatttacagctttttttcttccatattcttttgaaagatcatttattgtaagttccatatcaattctccaatcattttttcttttttcaagtacagttgaagtgttttccctaataggataatagataacacataaaatccaatccatccccagaacatagacgcttcaaatataaatcgctgatggagtacaagagaaaatgttccagaaagaaaaatcatacaagcgattaaatgatacaagctatcgtttgtcctgcttttcgcacatataaaaagataacaagtgcaagaaatattaaatggaatcaaaccatacaacaccatttcaatcattgatttctggtaaatatatgccattgaaattaaaatgactgttattaggaaaaggttgattactccaataatcagcatacgacctgctacaatttttaccagcgttgttctactagactgttcaatttcccacataccatagatgttgcttttagatatttctattgcacctaataacgcaaggaatggaaccataactgcaaggattgtcaatggataataaaatggaaccctccattggcccaggatacatgctaataatactgcacatatagtgagtattatttgaacaatccagaaagaaagcggcagaaattgaagttggttcaatataatatctcgcattgaatttttattgaattcagaactattcatgtaactttttccagctacgattactgctttaattttagtttcagatggagcaggcgtttcacaactctgcaaccattctaatacaccattttgtttttgggtcatacattatcgcctcctctaaaatcagccaaatatcgttccagttttttaatcccctgttggagcctagattttacagtagaaacactagcttttgtaatggttgcaatctctcggattttcaaatcataataaaatcgtaaaatgatgacctctttttgatagtccggtaatgtgttgattgcatattgaatttgcgctttaagttcgttaagctcaattttttcaaaggcattatcagtatcttctatatcttcaagagtttctaaatccatatacaggggttttgctttcttagtataattgttacaggtattaacagcaatcgttagcaggtagttttgaaatttcccgatctttcgtactgattgaatattctccaacaatttcaagaaaacatcttgtgtaatatctgcggcggtatctggattgccgttcaatcgccgacaacaaaatagataaattgactgataatattttcggacaattatctcaaatgcatctgtgtcacccgactggatttttttaattagtatgaaatcttcgataccgtgtcaccgccttccatgtgtaaaacgccttacacttaatatacaactgagtaacccaaaaggatttaactttagaaatttttcttttacttttttcatttcccttctattgtaattcctgttcttgaaaaatataagatgtaatatatgaattataaacttcaaccaacctgcatatagcaacattccacgggcaaagtatgaattatacaatgtaactgggtgatgttatatggcgaaagttgaagattgtcccggttttgaaaccttcggcgcagatgtcaaagctgcacgagaggcaaagcgtctggcacgaaaaacattggcagaaatggttgggattgaatggcggtatcttgccaacattgagaatcaaggtgcgattccgagcctgcctgtgatgatccagttgattaaggtctgcggacttcccgtggaacggtattttaacccggagattatgcgagaagaaagcgaacagcggcagcgggtcagccacaagctgaaactctgccctgaagaatacctgccgattatcgaaggtgccatagacggggcgctcaaaatggaacagactgcgaagcagaaggaggacgcataatcgcggcctccttctggcatttctatatcaaggttcccggcacttttccaaaagttcccgacacctctgctggatttctccggtttctgtcacagtcaggtcacggtcatttccagtaatcttatcttccagaaagttggcgtatgtacccaacaaagcgttccgtaaatcctccggggttttctgtatttcagcgctgtaccagtcattccggtggggttcccatgccatcaatgtataaccatgactggtctgaaccacctcatacagagggtcatcctccagatatgcctgaaacactttcaaaaccttttcaaaggtcagcatttcccgcacctcccattcagctgcaaatcagttccctgattaaaatttcctcaatctgtgccgttaatgtgttcatcagccccacccaacgcataggatcacaggctttcagttcttccgtgacacccgcagtctccatcatgtgaggcaacatggtgtccacacgctcctgcgctgtccggtcaatctctatcaggtgcggatacagcttctcgctcatcagcagttggttgtagagaatggggcgatgttcctttaggtaggattttcgcattctgccgtacttgccgatagaagtttccggctgttcagaaagttttaggttgggtatatcataatctccacaacgaatgtaagtcaacttactcatattcatgctcctttgctccgtgatgattagactgctgcgctggctgctatgccgcctttgcgcggttcttcttttggtagctgaccgatagtagaaaaaacaccttttttcatatcctcagcccggatcatggctttcttagcgtccatttccgcttttttcttcgccttgattttgtcctcataccgtttctgtgcgccgctggctttccgcttcaaataattctgatgaagcctgtccttgcgttcttcttttttccgcagttcttcctgttcctccggggttaaaggaaccggctgtaaggatggtgggatatagcgtcctaaaaaattgaagtagatttcaatttcctgcgtggtgtcctgactgccttttcgggcgcgttcgtggacaaggattttctctacaaactcgttgagcatggtgtttgtcagagtgtcaaaattctcgtacttatcaattagggctataaatttctctgcggatttctggctctgctcatagccggtaacagccttttccagctccgcaatttcaatctcaagtgcgtcctgctctttggcatactgtgcatcaagcgccctatatcgtgcatccggcagcttgccgagggcattgtcctcatagattttgcaaatcagtttttccagttctccggctctcttttgggcagcagccaaacgcctgcgctttttcgatatatcggcactctgttgagcaacctgcgtttcctgaacggtgtgaataaattccgtccggtcatttctggaatattcagcgatagcccggagcgtgtcagaaaccaatgtcagaacagcactctcattgatacggtgttgtgtagggcatagtgtcccacacggaactttggtataattggaacaggtatattgagaaatccgcttgccattgttggtgcggtggacatacatcttgccgccgcaatcggcacaatagagcaagcctgtgaggggagccgcttcgccccagccgtttggataacgccgtacattgctgcggattttctgcgccaaatcaaaggtctgctggtcgataatggcttcatgggtattctcaaagatcgtccattcgtcctcagaaacatagtggcttttcttgtccttaaagtgcttgcgggtcttgaaattgatggtatgccctaaatactctcgttttttcaaaatgttcacgatggtagatgatccccatccataggggtctttgaccggctttgaacggttcacaccctcgttgaagcgggcaaggtgtacgacaggaatttcaatccggtctatggataatttgcaggcgatctgataaggcccatatccctccagcgtgagggagaagatacggcgtaccacttcggaagcttcctcatctaccaaccaatgctcccgcttttcatcccacaagtagccgtaaatcacagtaccggtcaggtgcttgccgctcatgccttttgacttaaacacagagcggatttttcgactggtatcacgggcgtaaaattcattcatgatgttgcggaacggggtaaaatcgtcatcgcctttcagactgtccacaccatcattgatcgcaatcagccgaacgccgcgctgccgcaaaatctccataacttgaccgaccttcagatagtcgcgccccaaccggctcatgtccttgatgacgattgcctctacacgccctgcctccacttcctccatcattgccaaaaatccggggcggtcaaaacgggtgcctgagataccatcatcggtaaagtgcgtagggttgggcagcccgttccggcgggcaaaatccgctaacatctgtttttggttggatatggagttgctctcaccctgtaactcatcgtcccggctcaggcgctcgtacagtggggtgattttttcgtttctcatagctgtacctcctgaaacaaaaatactctaagtgattgcttcactaaccatgacacaatcatgattaagaagtcacttagagcatatatcacccgccgccagcttgtattttttatactgtctgaccgcaaagtggttcgggttctccttttccagctcctcaaacagcaggtcaaccgcatttttgaaattctcatcatcttcccttgcttcactggcatccaccagatcaatcagcatggaaaaattctgttcctcctccggtgcttcgtaccagatatatgctatcagggctgtataatagagcttttccgctttcacccagaaatcctcagaggcttgctgtccttcccctttggtatttacaatgattgtgtttacgagtttcagaatatccttttcgctacggatataagcgaaaggattgtaatgcattgattttgcaaagttaatggtattcagcaccttaatccggtaattattcttagacagcattttgccacattccacgaggactgtgcctttgggatcagtcacaacgtaggaactgtgcatctgcatgaggttcggctttacaaaaaatctggtcttgccggaaccggaaccaccgattacaagaatgtttttatttctcgcatacttcggctgttttggtctgcccgacatcataagccgctccgttgccgttaaaagcacgttattttcaaataccggatcaacataaggctctatgtctttggcagttccccaccttgccgaaccgtactcaactccctgccggaatttctttgcatttttcgctttataataaactaccatacgaaatcctattccgcatcccactcctaccagtaaatctctcggcagaaaacttggaagcggattatggaacgcacctccaatcccattgattgtgtccaacaccttctgtaatgtattgtcacctgcctgctgtccatacagccatgaaaccttattcagaacatacccgaagatcacatagggagcgcacttcagggcaagctgtttcttatttaccccttttgttttttctttgagagttttcggaattgactgtaaatcctttttaattccgtcaatgaccttgcttataagctctgtcctctgtccttatttttctctctgcttcgctccctattcttattctgtgcaacaatcttctgaagtcctttcaatttctgtctgagtgacggacgctgctgttttttctcattaactttgacaaattccttgaatgcctgtgcaatcacatcggcatctttgcccttgaaaaatacaagatacttaggtggctccgtggtcttatcccgcttcacagcgaaatcaacattgtactttcttgcgacacgctcaaaagatctgatgttgctatccgtgacctctatggactttgcaccctctccctgaccgaccagcttttttaccggaatttttccatgcgaaggctccttatgcttctggtgttccagatacatcttcattgccttctgtaaaacgcttgcggtcagcttggaagtcttgattgcaagagcaatggttttctgtgttgtttcctcctgcacggtgtacctccttccttatctgcaccggttggattcagggtggaaccaacagcctgtgtaataaatatttcataagctctcctttccacttctggacattttgtccaaaagtcctgcaaacgcaaaaagggcagctacaaacctttgcggtctataactgcctttacgctgttctcacatctctataacactttatcaattgcttgaattatcatcgatgaatcaatattggctttatttaatatcatcacataaatgaatgctcttgctagcaaataagcaaagatatgaatatcattgaaatttcctatactgctatggataagtagatttctcttctttgcaaactgtaatgacagctcagcaagttcctcctgcgtaagatcaaatctccacaaaatcttctttttatattcatcaatactcttttcacattgtgaattacaataatcgaacttctccgctaagccaaaatctaacaattctattatatctgcatacttttgaaattctttacgtttcttactatcttttcctttgtactcttctcttttcaattcaatgtactgtaaaaactcattttttacttcacttgccttctcgctattttctatcttagcatttggaaatacataattaaatactgattcaaagcttgtacaacatatcatatatttttctgccgatatatatttatcctctttttcacaacgcggaatgaataataaatttaaatcttctttgtttacaatttgaagcaattcatttatatgttcgaaaacaaaataataaccaataattctatctatgttagaaatatcattcttctctttttcattcagatatatgtagcctatatgctcaattctcttttcctcatttgtttttcccaattcgattttccccatgcttatatctttacgaaaattaagaaataccattaaattataaatccacatatatatcgttctaaactcagatacatctactggttcatgaaatgttaagcgaaatatagattttggttttcctaaattataatcaatctgcatatgtaatggttctcctggcaaagtaacacttaatgtcagtattgcttttttcccagccacttcaacttcaatttgcttacttgtttcatcaaatgtttttaattttaatgttgcctcacctgtattataatcatattgagtattactttcatcaataatatgatttggacgatagaaataatctattataccacctttaaatgtgattacatcaaattttctctcaccattactaaagcacacataacccgcaggctttgcaatatatcccgacaaagatacttgtagacgacaattcaaaaagaatattttgtcaaatccaatagtgtccccctctaacacctcataatttatattcttatttttaaagctatcatatggttttattgactcttcatccttgggaactaactgtaataattccccatcatatgtaaaaatgtatggtttattcatgcaatttatataaccactttgcaatttattctctaccatatacatctcctcctctcctttaatataaatctatttaggcgtttgcgaaacgccacagaccgcataaatacggcattttttgttaccaaattaaaataactcctcaccggatatatatccggtgaggagttattttaatttggtaacaaaaaatgccgtatttatgcgggctgtggcgtttcgcaaacgcctaggaaaataataaaatgtgaggtaatgtaaatatgctaagattaagaccatacaataaaaatgatgcagaaataattatgtcgtggataaagggagagaatgctttttataaatggacagcaggagttttaggtgaatatccaatttctgcggagcagttcaatatggtaagtaatcttatggcatttactgctattgatgataatgagatagtgggattttttaccatgagaagaccgaatgaattttatgaggaattacggtttggctttgtaattgttgattcgaaaaaacgtgggcagggatatggaaaaaatatgctgaaattaggcttaaaatatgctaaagaaatatttggtgctaataaagtttcattaggtgtttttgagaataatgaatcagcttattattgctataaggcaataggttttgaggatgtatctcaagatgaaatagaaaagtatactgtaatgggagaagaatggaattgcttagaattggaaatgaaactataaaataaattgtcggcagaacgagatacatttatgaaagaaaaagaggagtatttggagagtattcaaagtaaattaagaaaattgttgtttgaagaaattgcattagaagatgctagaaagatgtataattaaagcagtgatataaaacaacattcacagcagatttatgtgaaaaattgaacccaaaaaagagtttgaataatttttttttaataaaatatagaaggatttatttttcaatagtaaatgaagaaggctccaggatattttaagagatcttctgggaccgtttatttatgtgtggtatactggaatatatctatatgaaaatttgattcaaagccttatccaagtaagatatggaaaatcagatgctaaacatatattgcagaaggagaacagtgtaatgatagatatatatacggagaggaaagattcaaaagactggattttttacaatgacttgtacttcaacttgaatacaggcaatgaagatatgtcacaaaaagaaattgatttgattcaacaagtggatgaagcgaagctgacaccagacaagcatatagaaacaaaatatggcttaggtacgatccgaaatttatcatcaggctgcaagacattgcttaatattgtgaagcaccccgataaggtggtaaatgttgaggaatgtggaccgaatgttcttaaaataatttttactatggataatattaagatttatatgtcaagaccaacgctttttgatattccggatgatgccaaaatcagatttaatgattctgatatagttaccggtggcagaggatataatgcttggtggagtaaggagtatcaaaggagagaagcagatgatttataagaatataacatttaaagcagctccattttcatatgatttgacatttgatgacaggattactcttgttggtggagatagcggtacaggtaaaacagtactttatgaaatgctggaagatataagattgacagacgaatacaaagcaatcaagctatttaactacaaatcagatgattttttagaagcaatcaaacagtgtagagatagttttattgtgatagataatgcagattgtatgattaatgatgatgtcaggagattcattaattttgagttgtctaatcagtatatgctttttctacgaaattgtgacggactcaatgtatcttataagagctttaaggtgctgaagtttgataataacaggataacactggaagaggagttgtgatatgagatatttatggacagaggatatcggtgcaggacttcacttctagaaattagttaatcagctttttttgacaatgaacttgtagttgagagtaaatggagcaatcagggtttactggatgcattaatagacttggagactgaagatggagatgaatacttcgttgcgtttgattatgtggttgataatcaggacatgctgtcaaatgtaaagtggggcaaatatataataggtgatttgtttgaaggatagagacagcaatgcttccttataaagcagatgaattgccaaagaagaagctttctaaagcgtgagagacgcttaaagagttttctgaaaaacgaatatttcaaagttagtctcaacgaagtctcacgagatttgagactgagtgagactctatgatatagcaaaatgcgataaaaattggtatttgcaggtaaattataaagttgtagtctcaagacagtctcatttttgaaattgtttgttgagactaacatgagactgaggaggttcaaaatcatgaacataagcaaaaaggattggaaattatttcgagaaagattatcaggctggcaggaaaattatatggaaggtcttgttaaagagtatgcaaattttctgaatgatgataaaaagcctgcatcagagaaattctgggaacttgaaaaacggataaaagaagataagcgtcatccgggagttatcatggagatgagtaagtcagaggtgatatgggatatcgttcgtcttattagattgaaagtaattacatatgatgatttatcagactttagtgatgaattacagctggaagtgaagagaatacttgaaatgagcaggtgatacatatggagattggtgcaacaaaggcagttcaagatcgactaaaaaccacaaagattgcagaaagcaaaggtgtttcacttgtgttctgctgggacacacatttgacgaaaataaaaggaagaaatgtcttgtttattgtaaatgccagtaatcgttatacaatagcaatgacagatattgaaccaagaaactggaattactatgcaatgtatatcagccgcgtgatccatggcgtgatgcaggaaatgggatattctgaagaacagatagcacaatattttaaaatgtcaggcgatatgattgtgacaaagacacatgggaagaaatcggttggcggcattaatagaatggtaacggatgcgcagtattttgataagaaactggagaaagatacaaaatatcagtgggaactgagtgagtatcttaacagagatatttgtcagccagagggattcgatgcatatggatatccaagtgaactctttaaattagacatggaacgattaggaattattcctaagagaaagcctgcaaaggtaattgattttaccaggtacatagatactaatcgcagttctaaccattagcgcaaaagaattgttaaaacaattgtttgggcataagaagttagtttgcaatgacgaaaagcaagatgtataaaataattcgtcgctaaaaaagtgacgaaaaaagcgacggaaaaggagaacatttatgagcataacatttgaaatagtcaaatttaaaaagccaacaaaagatgatttgtctaatttacatatgtttaatccttatggttctattccaatattagatgatgatggcgatagcacgggatggaatatttatatgttcagggtcgatgataaggatatacagaatattataaatagcagttatgcagtcaaaatggaactcccagaatgcattacagattatgatagtttttttgaagatttgggattccctaaagaggcagtaaggaatggagatgttcgcattataaaatccaattccagatatattactatttcttatggtgataaatcaaaggagatagaaaaaagcaggcttgaaaaatataaggtgatggttcaaacaaaatgtgttgttttgaagattaaggctttatggaacagcagtgaaaataatctatatggtatagataaaaagaaagctataaagtgtataccagatattgaaaattatgaatatgttccagttaataatagtatgctggcaaaagcagaaattcccttcttgatatttgaaagaaaccggggaaaatgttttatagagatgtattgatagaatctagagaaaggaatgcttttatgagcaaagaattacagataagaaatagcactgttgatttcttggttttcacacgagatgcaggagaagacggaatagaagttagggttcagaatggcgatgtatggcttacgcagaaggcaatttcacagctttttgatgtagatagaagtgtggttacaaaacatctgagcaacatttttaaagagggagaattagatgaaaattcaacttgtgcaaattttgcacaagttgccgacaatggaaaaacatacaaatataaattttattcgttagcagctattattgctgtgggatatcgcattaattcagaacgggcaacacagttcaggacatgggcaaccaaagtgttggatacatttacaaagcagggttatgttcttgataaaagcagattgattaatggacagattttcgacgaagattattttgagcatcttattgctgagattcaggaaattagagcaagtgagagaagattttaccaaaaaatcacagatatatatgcaacagcagttgattatgataagaattcacaggtgacaagagagttttatgcaacagttcagaataagatgcattatgcagttcatggtaatacagcagcagaagtgatagtggcaagagctgatcataataagaaacatatgggacttaaatcatggaaaaatgcgcctgatggtaaaatagtaaaaacagatgtgtcaattgcaaaaaactacttaggaaaagaagaacttgcagaattaaatgagattgtgacaatgtatcttgattatgcaacaagacaggcacgaagacatattcctatgactatggaagattggaaaacaaagcttgacgcatttcttagatttaatgatgcagaagtacttcaggataaagggaaagtaacagcagctattgcaaaggaatttgcagaaagcgaatttgagaaatacagagttatacaggattcactatatgaaagtgattttgataaattgatgaatgatatggaaaaggatgatgctatccattagtaccacaaaatttcttattgcagaattagcggttgcagattataattttcgtaggtggacaagcaaaccgatagaatattattctgtgaataaaacacaaacctgcaagccaccggaactacacacaataatgaaagaatgtaatggtactggattggtgctaaaaatgtgtggaatgaaaaataatgagtagaaaagatgtggactatcaatacaagaatgtatagataaccatattaaaacaaccagaatcaaaccaaactttgcgagtttgagtaacgtataaagtacgggagcccgctatttaagcggactcccgttttgcgtgcttgcaaaatgcttgcaaaatgcttgcagaaatacaatgacagaaaatgaggacttaaaatggtcattacggaactaagtttagtagagtattatgataaaataattccgagagcaaaaagaaaaaattacaaatgggttatttcggtgatagcgcgtcatgctgatgctaaggagttatatcagcatattgaagaagattgggcatcaattaatgatttgacatatgacaatgttttgtttgtattttcacttggagctagtttggaaaataattctttctttcatacggaaggacaagaaaattatgtaggcacaatgtgtccttacgttgaaactattaatgaagaacgaatagcaaatagaaaagaagatttttatattcatacatatggagcagctgatatagattggaaacaaaagcattctcagtcggttactgaatttataaggaagtatgatattagagaagaacaacttccggttttattcatttggaatttagaaagaaattgttatagtgttgtttcattaaatcacagtgaagatatgtactcgtttttaaagcaacgtgtattggaacaagagaacttaatgaagcagaaacaaaaacttgaagagaaactgttacctttcaagcaggagcgaatgtattttgaattgtatgatttcttgaatgagagagcgtgtagacttggatgtagtgaaaaagaggctatacagtcagttttgtttgggcaaagtacatatttagagaaaaaagaccagattcaagataaagaaataagaaaagatttaaaaaaaataggacaatggaaaaaacaattctttacaaatccatcggatataccacaaataaaaaatcatgttaaagagatgttagaaaaaaagatgggaatagaatatagaattgattctatatgggagaaaatcggcaataagggtgaaatggttacattaacgaatgatattgtaaaggatgttatattagtttgtgcaaaacttatctctaatgagatttattatgatgcatcagaagatagaaggaacacatatgtaagagatctgttagatgaaaagggatatgtagtaagagatcaaacaagacatggattatcgccacaaggaaaggatgcaggaaaagttgacatttctatttttaaagagggaaagacatacacacttatagaagcactgaatttatcctgtttaagtaaaaaatatatagacacacatctagataagatatttgattatgatgttttgggaaatgatatcaatataattttaaactatgttacagttagtgattttgataaatttattactaattatattacttatatgaaagaacgtaagtggcgttccccgatggttgatttagatgaaaaatgtaaagagtataaaattctgtattcaagcataagagtagtaaaaacaactcataaaagaaatgggaagaatacaattttatatcacatatgcgctttaattaatggtgctaaataataatggaattatttaatgtttgtaacccacaggaacgctttagtgagcaacaggctagacgtacattggaaaaaatgcaaaaggaatacattataaaattagctaatgggggccggtatgcgaagtatacactaatttaacttgttgttttaactcggctatgccgaattaaatgccgagttaaaagataaagtatccaaaatgccttgaaatacgtgactttgcaatgtacttgtttaacttgtcagtgtcgagatagatgccgagttaaaaattatactcaaatggtattggaggaaattgaaatatggtaaacttaattgcttttgatacagagaaagaattatgcgaattaacaggtttgacggagtctgagctgtgggaaaaggatttattctcgatgattgggatattgggtttcaatcagatattaaattacatagaactccgacggctgatgatattcaggatggttatgaggaagatgaattgattgacgattatgatttgccggcacattggctaatgatgcagatgaacaatttttgcgttggcgctaattacgtgtttttgaatggaaagcattattatacagttcatcactcgtaagtcgttttttctcaaaaattcgataatacaacagcaggaggtacacatgaaagtaaaattacaagaagttctcgaggcacttgatggtgtcggaatggatatggaatattattatgacacgaaaaatgaagaaatcctgatgatatttgatggtatggttaatggagaaacggatcctgatttgatagaagatatcgaagagggttttattgaagattatatcccgttgccacggcagtatgatatgaatgaatatcggatgatggaagaatttatttatgacttaccggctggaagagcacaggacgcattggatgtagcaattagaggcaagggtgcattccgtagatttaaggataggctgtacgattttgaccttcaggagaaatggtataagtacagggatgattgctatgagcaaatagcaagagactggtgtgaacggttcgggatagagatagaggaataggtatggctgggacaaatgatattttagaagttgcgaagatgacaattaacgcatcgataaagtgcaatacggttcgaggatttattggctggcacagttgcgataatatttgcatggatatgcatgatgtattggatatgtgcgaagatgcttttaagcgggaaagatatcaggaatctcttgaggcagatacatatgtgcttgtttcgggcgtgaaattggcttcttgtgcagatagcagttccggtatgctgacggatgtaataatgcgtgcatttgaactaatagatttatctacacagacaattgccaaactggatgcagcaatgagaaaacatgcgctgtcattgattataaaggaagcaaagaaaaaagcatttgacggctgggactcatggcgctatgaattattgggaaaggcggtttgtttgtgtgatgagaagttggcagtaaaattggaaaagcttttggatgtattcttagaagatattgagaatgattatacgccggaatacaaaaggcaggaagatacaattttacgttataaattgcatcgacatttaaagggggcagacgcagttaaggacgagttatatgcaaatctacatataagagaaatacgcataattgcagttaaagatgcaacagatgcgaggaattataacgaagcagaaaagttgtgccttgaacagataaagaaagaggacggtcgcttttacagaaacattccggaggattggaataatatactgtttgatgtttatgtgcagtcaggcataacagataaacagattgagcaggcaaagaaaatattgttcctggggaatgcaggattctgggatgttttaaagcggctgtaccaaagcttgggaacatgggaaagtcagaagccaattatacttaaagaattaaagcaatgcaaatattcagtatgttatcggtctgtattggttgaggaaaacgaaaagaagttgctattagaagccgttacagaaaatccatataatttgttctattatgctcaatttcttgtaatggattatccgaatgaaatttatgaattgtgtgcaaattacataagagaacaatgtgcgcaggcaacagatagaagattatataagaaagtatgtaaggacttattacagttgattaagtggaaaggaaatgctactgccaagctgcttgtggatgaatttaaggcaacgtatcctagaagaagtgcgttattggacgagctgcaaaaggtagagaggaaattgtaagtgttacttggctgttgcattatttgcaatacccactgaaagccatcggaacccactatgtttcttggtactaacaacaacagagaaaaaggattctccacataataaatgtcaaaagaaacattgtagatttgaaaattgaggcgtttggtactgttattttactgttgttttttgcaagtggctttgcagtgctggcagtgatgcggatatgcattgttttataaggatttcagtataagtgaaaatgtttcttgtaatttacccaaatggattctataataaaatcgtggttggaaagggattatgaacttattgctttgggtagtgtcaattggcacgccaaatcagggaaaaaagaggtaaagaatcattttcaagccaacggaaccatttataatgataaaaaatcgttcataaatgatcgaaagctgagtcgaaaattgcggtactaaaatggtactacattcgatttgaacgaaatagaataggaacaaaaacacatatttgcaatacaaatatgtatagaaaatcaatgaaaaacaatatcattcacatcaaactttgcgagtttgagtagatatttttgtacatttatagtccgcgaagccagtaaaatcaaggctttgcggacttcgtgcttctaaggtggtaataaaatggtaatgtttttagagccgaaactgaaatttcattctacaaaatttgcgataggcgaatgaaatagatagaatgttaccaaaggacattgcaaagtatttgtggtaatggtggaaaaatttagctattggagattgtgcttaaagtatgcctgcaaagggatatatgtcagcccgaaggatttgatgcgtatgggcatccattcgagttatttcatctggatatggaaaggataggtatagtgccaaagagggcgcccgctaagataatagattttcgggcacacatagagaataaacatactatcgattagtctgatgaaaaatagcagaaacatttgacgtgacatatgaggaatctttcgcgtttagtggcggaatcagtattgattaagacataaagaaattggtaataaggagagatggaatattatggcaaacgaagagatagctagtcaggtgttggattattggtttgcgattgagttcttggggcaggactcttatgatgtatgtactgaagaatccaaacttgttcgagcattaaaaacatttaaaaaagctgatcagtctacaaagaataagcgtaggcaaatctctgtttttgaacttgtaaatagcgaatctgacatatattctcaaattgtgaatcaagcaaaggaatgtgatatgacgatttggggaaatctgacattctatattggcagggtgtctagacaggcgtgcatagaaaaacttgctcaggaacttggtgcaaagctagagcaggaggagagaaattcagagtatataccaatacttagttttcagtgcactacgaacggagcttatgtagaacattcactttctctctctactgttatatgggcaatatctcaggtagaaggaaaacaaaacggaaaactatctgatctgttatcaagtagggcgtattctgatacgatagaacagttggaaagggagttctttgaatcagataatttcaacgaacaagaggctatagaggaggcgtctgttaaggtgaattcggaaggtatgccagtttttgctgatgatgctatagtagcttcgaaaattatgagtatacattctgaaattgttaaaatgtatggaaaatttttcccggagaatgtgattgaggaaagaaatggttttaaatatcagttgtttaagaattcaaaagctaaagataaatacgacgatgataattatatgggattgagccatgatttcttttctaatgatctgaagatggtcaaagaatccatagaagcaggaaaagatgatttttcaacaggtatgttgtctaacctaattgattatatctgtgcacctcatgatgtcttagaagaaagacaacgtcatgatttcgtcagacctaaagataaagaggtattttataaggaaatagccgaaattctcaacatggagaatgctcctcttggtaaatggccgtccaggtatatgcctgcgttaatgcagcagattgctataaatatagcaatatcaaaccggcagagaggaatatttgaagaaagtgggaatgttttttctgtgaatggtccgcccggaactggtaagacgacactattaaaagagattattgcaaataatattgttgaaaaggccagagctctcagccaatacgatacaccggatgatgcctttgaaggtgtgaagtttgtgtgtggcgaattgaatggggcgtatgcacagtattatccgaagtggtttaggttcaaagatgaacatattgctgactttggagtgcttgttacatccagcaataatacggctgtagaaaatataacaaaggaactccctcttgaaaaagggattcttgataatttaaaaattgtttctgacggaaatatgccagatagtccggagaaggctcaacaattaagaacgatctgtaagatgttttctacttctgaaacagagaaaaaattaaacgtttatcaaaaagatactaagcgacagggtgaatacccagagatatatttcactgggtatgcaaagaaattttttggaaatgcagaaaaggatgcagatgcatggggaatggttgctgctccacttggtaaaaaatctaacataagtggtttttactatgatgttctgaatccaattttgcaggacttcatgataaaaaatgctgacattgaagacagaattcctgaatatagaaaagccagagatgcgttttctaaacaactggaagtagttagttctcttcaaagtcaactaaaaagttacggcgatatttctcttaaagcacatcagttatgtgcttcttttgagcaaatacgagctaaaaatatttctttgattatttgttgtgatgaggaaattaagtcttttgaaaatcagatagtttatacaaatactgaaataaaaaaagaagaagacaatctcagtaactttacaacattatattcagaagctgatttcaaattaaaagagtctgagaaaaggatgaaagatttgtcagaacaggaaattagttataagaaacaagctttagatgtggaaaattctgtcggtttctttacaaaaatttttagaaaaagcaaatatcaatctgcgcttgatttggctgaatgctttagattgaaggcacaagaatgcacgattgctgttaatcaagcctcacataaaattggcgtagaaagagcgcaagtcgaaaaataccgtattgataaagataatgctttacaacgattacatgagtcaaaggaaagactcaaaaagctagagggaaataagtctactactcagatgagaattcttcggttgaagggagaaattaataatgcacaagtcagagctgaagcagccaagtcagaatgcgaaagagacttaagggaatatcttagtgctggagatatgaagacaggcaaagttctggatgatacatttattgaggatgttctttctaagaatgataaagtatctactaaagcgcagatttctaatccatggtctacggaagaatttaatcgagaaagggaaaaattattttatctagcccttcaaatgacaaaggagtttgtcctaagttctaagtcgtgcagaacaaatttgtgtattttaggtcaatattgggggtttagaacagaaaatgatacagatagaatcaaattccataagcaggatagagaagcgatgatagcctcattattccagacattgttcttgattacaccggttatatcttctacgtttgcttccgttggaagattattaagagatatgaaaacaccggggtgcataggcacacttgtaatagatgaggcagggcaggctcaaccgcagatggctgttggtgcattatacagagcgaggaaagctataatagtaggcgatccaaagcaagtggagccagtggtaacagatgatcttaagctcttgaaagaggcgtattcagaacctgtatttgcaaactataaaaacaagtcattatcggtacaaagctgtgcggatataatgaatccttttggtacttcctatgataacggaacggattatcctgattgggttggatgtccgctgcttgtacatagaaggtgtatttctcctatgtatgaaatatcgaatcgtatttcatacaatggaattatgaagcaacaaaccttgccaccatcagatggtaaggttgagtcttttatttacgaaaaatcgcagtggataaatgtaactggggttgaaaacggacatggagatcattatgtagctgaacaaggtaatgttgtctgcgaaatggtaaatgtttctttccagaaggcaattaagatatcaaaaatgcaggttgacaccaagccaagtctctatattatcactccttttactactgtggtgagtggattacggaaggcaattggtacatatgcaactagaaacaaaaactctgctttaggggttagtacatctcttgatgaatggttatatgataatattggtacagttcataaatttcagggaaaagaggcaaacgaggtgatttttgttctcggatgtgatgagtcgcagaaaaatagatatgctgtaaaaggtttcgtaaatagcaatatcgttaacgtggcggctaccagggcaaaatataggttttacatggtaggggatcaaaaggtttggggaaaaaatgaatatgttaacgaagccaagtctattatggataggttacttatagaggatgcggaagaaaataattaagctctcctgagtcacattgatcaatttctagaacatcattatatctgtttctcaaacaggaaagagccaagatagagaattagaatgtgagttaggaataagttgattccatgttttagatagggatgaatttacttttacaaatgaggcggagaggttgctctatccagaaaaattcttgttgctgaatcattatttttaacgtaagcgatgaataacataccgttccaaatttaattgaagatttgggataatacagtcaataaacagtaaatgactactttatctattttcagatctggatgcggacgtatcactcttcttttcttaagcaaaggtagccgtttacggtgtttaactactttagctaacaggaggagcagcttatgcgtaataagagaagaacagacgaagaatggctgtcattgattcagcaatgtcgcagcagtggattttctgaccgtgtctggtgtgagcagaatgatatctctatcaatacgttttataatactgtcacaaggctgagaaagaaatcatgtatgattccggagacagacaggctaatcgtggatacatcagaagctggagctggggcaagtgcggtaatgtacagcattgtggaaacagcaaaagcaaacaatctgaatattttccaatatctctatatggtactgctgtatatgacggattatatgaactcgtccgcaggtatagaacagctgatgccatggagtgattttatcaaagagcagtgttcggggatcattgatgtggagtccactgtcccggaaaacagaattcccctgccatgtagatagcagggaaaatctaaagtaaatggtagtcgtttactgttttgggtaggcggtgtgttattcatcgcttacgatgaaacgggaaatgcaggaagcagtacaggcaggggagcgggtacttcagaccctttacgcagcaagggataagttgggaagtgcgagaaactggggcatttttgatatgcttggaggaggctttatcagtgaccttgtgaagcattctaaaatgaatgacgcatctgcgttgatggaacaggcgaaaagcgatattcagcgttttcagagagaattaagagatgtgcaggtttccttggatctgcgcatggaaatcggcagcttcctttcctttgcggatttctttctggacgggctggtggcagattacatggtgcagagcaagattacagatgcaagagaacaggtggatgatgccatcaaccggatagaaaagatacttgctgatgtgaaaaatcgaatgaatgcggaggtgtattaagatgcgattatttgataaaaggacgccgcttcagaaagagtgggaaaagctggaagtacaggagcagagattccttcagaagcgttctgagaaaagggagaacattctgaatcaaaaactggaggaaaagataccgccgaaacttcaggaaacattggatactgcttttgcgaaggcatttgctctgattttcgagaaaggaaccagggttattgaaaagacgtatcagcgggcaaaactggagcaggattatcaggtgcggcagtatacggcggatgtaaagcagaattccaaatccctgcgctccttttctaaaaaggcaagagatacgggaacgaagaatttactgctatccggtgtggctggaatcgggatgggcgtattgggaatcggtctgccggatattccggtatttacagggatgattttaaagaatatttacgagactgccctgcagtatggatacagctacgaaaccagggaagaaaaatattttatcttattattgatccggggagcagtatcctatggggatacactttgtgagattgacgggaaagtaaatgaatttatcagaaacggaatgctgccggaagaatatcaggataaggagcagatcgaacaaacagcgggatctttgtcaaaagagcttctctatatgaagttcttacaggggattccagtggttggtgctgtaggcggagcttatgatgcagtctatatgaaacggatcacagagtatgcagagctgaaataccggcacagatatctggcggggcggaaaaaggcagagaataaattgttgttttgatgtgtgtggagtataatgtgtttattagtcaatgcttaacactgatgaaaggaaaaatatggttttagaaaataagcttaatatcacagactccacagaactagtgtactggcatattgatatttagtcaattatttctggctgttattgccgtgaagtgtggcaacacatggagctgactgttactaataggtcgagggcttgattaaaaagcggttaaatctgtatgaagttttgaaagtacaaataatttgatagaaagttagcaacgtactttgtctacgttgttttctcatataggggattggtcaaatggtatgataggggtctccaaaacctttggtgggagttcgattctctcatcccctgttctttaaaaacacctgtttaggtgtttttttatttatagtaatttaaattaaatttttataaaggagaattatatgaaaaaaacaaataacagcgtgctttcgcaatatcggggtgcgttaatgggaatatccatcatattgattatagtttttcattttacggatgactgtcattattactcctatcattttagtggctggatttccttcttttggagatatatttcatcatcgagtgttgatgcatttttattcttttctggtctgggattatattattccatgaaaaaaagatcagatgttagaagtttttacataagaagattaaaaagaattctgattccttattgcatcgtagccgtaccctcttatattttactggatgtctgtgtagataaaacaggatggggagaagccataaaagacttcacatttatcacatttttcagtaatggagacaggctttactggtatattggacttatgctgttatgctatttgatttatccctatatctttcagattgtggatagcgcacgggacgcaatagatggagagatccggctgatttccatggtaagtgctgttaccgtattggcacttgtaattgcattatatgagaaagaggtgtttggaaatgtaaatattgctttgcttcgtctgcctgtttttatagcgggctgtttttatggcagatccagctatgaaaaaagggaaagttattggaaatggttgattctgtttgcgttatccggctatttgctcaccatgcttccaagtggatctcctatttttgcaaggtatgtgaccggaatttttaatatctcatgttgtgcgggaattgcctggatcttttccaagttatctatgcgcccggttataagaatactggaatggtttggtgctcattcgctggaattgtatctggtacatgttaccatacgaaaatttatgaagggagtagcatttcatacatgccgtctgcgttacgaactggtgctggtatgcagttccattgtgattgcatggatacttcagatccttgtccggtatataacagatcatttgcttaaggaaaagaggtaagacatatgaccctacagcagttacatcaggtaattacgattgcagaaagccgctccatgaacgaagcatcccgaaaactgtttgtctcacagcccaatctgtctgcggttgtgcgcgaactggaggaagaagcaggaatcaccatttttatccggtcaaaccgcggaatcgtgcttacactggagggagaggaatttatcggatatgccaagcaggtcgtggagcaatatcatttgctggaatcccgttatatttcgtctgcatccaaaaagaaattttctgtgtccatgcagcattatacctttgcggtcaaggcatttgtggaagtggtcaaggctgtcggaatggaagaatatgaatttgccgtgcatgagacacagacgaatcaggtaatcgaaaatgtgcgcaacatgaaaagtgagctggggattcttttcctgagcaaatttaatgaagcagtactccagaaacttttcagggaaaatgatgtgatttttgaagaactgtttacctgtgacacctatgtatatctgtggaaaggacatccgctggcacaaagggatgtaatttccatgaaagaactgcaggaatatccatgtctggtgttcgaacaggggaaaaataattccttttattttgccgaagagatgaaaagtacctatgaatataagaagatgatccatgcggatgaccgggcgaccatgctgaatctgatggttggtctgaatggttatacactctgttccgggattatctgtgaagaattaaacggtaatgattatgcggcagtgccgctggcagagagcgaaaagatgcggatcggctatatccggcacaaggggataaaggtcagtccgatcggagaattatatgtggatattctgaaaaaaagtgggaaaccactttgataaaaatagttttcatcaaaaaatgcttgttttggtcattggaaaggcaattttttggagaaattgcataagatagcaggtataaatataaatacacgaaaaaaaacggtaagaatctgatggaaacggttgcgcgattaccgtcattatgcaggaaaaaccggagaaatgcgaagtttgcacaactttgacagatgagaaaaaaagtggcataatcttttctaaacttggggatgataataaaagtatgttgtttaaaggtagaaagaggtgttggattatgtatgaaactgttaaagtaattcggttatcagatatggatgaagttaaggattttgtacgtgcagcgggtggttgtgattttgatattgatgtaaaatgtgacagaacattcattgatgcaaagtcattgcttggtatgattggacttggtgtaaaaaagaatcttcaggtttgctacggtggaaagaatgaaaatttcgaaaacgtagttgctaaatttgcagtggcataatacaattattatatcgtgactatggaactttaagtcccgctccgtattccggagcggggctttttattgtaaaataatggaacaaataaaaacccgcttcatacaacaggaaaatacccgcgggagaaaggaggtgtacatgcaggaattacatatctctgtgagaaatctggtagagtttattttccgggcaggagatatcgataatcgtgccggaaagctggcgagtgcagaggccatgatggaaggcagccgtatccaccggaaaattcaaaaaagcatggacatctcctaccaggcggaagtaccgctgaaaattgaatggaaagccaacgattacgtattggtcgtggaaggacgtgcagacggaatcgcctatggaaaatttcagccggatctgccggctgcgacggagtctgtgctgcaaccggagatggagtttgcggcggaaatccctccggaagaagaaatcagcttcatcgatgagatcaagggtgtatatagaaacgttgcggcaatggaacagccggtctacgtgcataaagcccaggcaatgtgctatgcgtatatctatgcgaaacagaaccgtctggagcggatcggcgtgcagatgacctactgcaatctggatacggaagaaattcggtatttccgggaaatttatacatttgagacactcaccgtgtggtttggtcatctgatcgaagattatcggaaatgggcagactggcagatcgcatggaaaaaacagcggcaggagagtattcatacactcgagtttccatttccctaccggcagggacaaaagaagctggttgccgatgtttaccgcaccattctgcgggggaagaacctgtttatcgaggcaccgaccggagtgggaaaaacaatttccacaatctttccggcggtaaaagcagtgggagaagggctggcagaccggatcttttatctcacggcaaagaccatcacagcaactgtggcaaaagaaacgttcgcactgctggaagaacagggataccgtgccaaagtcatccagatcacagccaaagaaaaactctgcctgtgtgaagagatggactgcaacccggtaaactgtccatatgcaaagggacattttgaccgcgtgaacgatgcggtgtttgatctcttgcagaaatccaacctgtttaccagagaggaagttttagcgcaggcgaaaggatatcaggtgtgcccgtttgagatgagtctggatgtggcaacctgggcagacaatattgtctgtgattacaattacgtattcgatccgaatgtatatctgaaacgcttttttcaggaggggatcaagggagactatctgttcctggtggatgaggcacataacctcgtggatcgcagcagggagatgtacagtgccgatctgtacaaagaagacgtgcttgcagtgaagcggatcatgaaagcgcacagccgtacgatctgccgtatcctggacaaatgcaacaaagccatgctggaaatgaaacgtgagtgtgagcactaccagattctggacagtgtgggaacgttgaccttccaccttatgcggctggcctcccagatggatgaattttgggaaaaaccgcgggaatttccggagaagaaaacggtgctggatttttactttgcgctgcgcaatttcctgaatatctatgatctggtggatgaccattacgtgatctacagccagatgacggaggaaggccagttccggatccggctcttttgcgtagatccgtcggtcaatctgcagaaatgcatcgataaaagcaattccacgatctttttctccgcaacgctcctgccgatcggatactacaagcggctactttccacggacgaggataactatgccatttatgcgcagagtacgtttgcccagacacagagacttctcgcatttggccgggatgtgagcacaaaatatacgcggaggaacagaaaagaatacgaaaaaatcgcggactatatcggtgcagtcacagaagcacagcagggaaattacatggtgtttttcccgtcttaccggctgatgcaggatgtatatgaggtctttgccgggaaggcggccgattcgtgcgagattctgatgcagcatagtaatatgaaagaacacgaaagagaagcgtttttggaagaatttgaaaaagagcgccaggggacactcgttgcgttctgtgtgatgggtggaattttcggggaaggcattgatctgaaaaacgatcggctgatcggtgccatcatcgtgggaaccggacttccgcaggtcagcgatgaacgtgaaattttaaagaattattatgatgagcggggattgtccggatttgactatgcgttccgctatccgggaatgaacaaagtcctgcaggcagcagggcgcgtgatccggaccagcgaggaccgcggcgtgatccttctgctggatgaacgtttcctgcagcgcgaatacggagcgctttttccgagagaatgggaaaagagaagcgtctgtggtctgccgcagctgcgggaagaagtgagccggttctggtcagacgtccgggaggagctttaaaaactcttcggtggaggcagaaaccggaagggtagggtttaacgaagccaccagctgccgctgcgggatcgtttcctgcgtgcggacgaggaagagatcctccggcttgtgtttcagacaaaaatccgggataaaagcaattccaagaccgatgcgggccatgtcaatgagcagatcgttgctgctgagctctacctgaggcagcagttccagctgatgctgcaggaaaatgtggtgcagaaattcacttgtcgtgctcttgcggtctaacatcatgagcggataggtgccaagctccgagaaaggaacgatgcggtccgccagatcaaaatatgcaggattggcgacgaatacatccgagaaagagccaaccgttttctgaatataggaaggattcagatgcgggtttggaaaatttgtgataatcagatctacccggcgctgctctaacaggtctacacagcccaccgagctggcattggtgattttaatcggaacatccgggaatttccgatggaatttctgcagatacggcagaagaaaatagcggcagatcgtgtcgctggcaccgatatgcagctgtcctaaaccaagagagccggattctaaaagctggctttcgccgcgtgagatcagattcatggcaggttccacatgtttcagaagcagagcaccggcaggagtcagctgcactttttttgtgctgcggataaaaagcggctgtcccagcttgcgctctaatgttttgatagactggcttaccgctgactgggagataaaaagcttcttacttgcatccgaaaatgagagagagcttgcaacataatagaaaaccttgtataattcataattgatatccatcgatcatatcctcagtagtatagtataggatatattatatacctttcacaaaggagagaaaaggagattatcatgaaaaagggaattttgaaaaccttatgcggattgatggcggcactcatgctgcttgtgttcgcaggaacacccgttacaactcaggcagcaaaactgccatattacattaaaatcaatcgtcagcagaactgtgtgaccgtatatgcacttgattccaaaggcaaatataccaaaccggtcaaagcatttgcctgctctgtcggtgtcaacaatgctaccccgacaggaacattttcgattccggcaaaataccgctggcatacacttatgggcggtgtgtacggacagtattgcagccgtattcacggtggtgtgctgttccactctgttttttacagttcacaggacccgagcaggctggcatacaattcttataaccgtctgggacagacggcatcccacggatgtgtccgtctgaatgtggaagatgccaagtggatctatgacaactgcccggtaggaaccaaagtaaccatctatgacagcaaagatccgggaccactcggaaagccaactccggttcgcatcgatgtaaacagcccataccgcggatgggatccgaccgatccggatccgagaaatccatggctgaaactccgtccgacgattaagggaatcaagaataaaaccatcgagagaacaaacagcaaagtagatctgaaaaagggtgtgaaagctaccgattacagaggtaagacacttaaatttaccgtttccggaaaagtcaatgcggcaaagaccggaaaatataagattacatacaccgcaaaagatgccaaaggaaacaagacccaaaagagcatcataattaccgtaaaagatacgaaagcaccatccatcagcctgaagcgaaagacactgacctacaataaagccgtttccaaagaaaaactggtttctgcaattaaggcagatgtagtggcaaaagatctgggcaaaaaacttgcgtcaaaatatgttttcgtggatgccagagaagcacataaggcagttaccgctatggaaagaggaacctatggaacttatagcgtgaccgtatatgtaaaagatgcggcaggaaataaatccagaaagctgaaagtaaagattaattttgtaaatccaaacccgggtaccgatcagccggatcagccggaaccggacactccgggcgttgtaacggacagtgcaattaccgtacagtaatttcataagaacaggtaatagatatcgtaagcgatattaattttacttaattgtcaacccatgatacaataacataaagatcaatagaatgcccccaaatgcagggggcattccgtttcgcaaaagaaggaggtaaatccaatgggcaatgtacgtcgtgtgtacgtagaaaagaaaccggattttgccgtaaaggcaaaagaattaaaacatgaggtaaagcattatctcggaatcgctgcagatcaggtgcgtgttctgatccgttatgatgtggaaaatgtatcggatgccacttaccagaaggcattgcagacggtattttccgagccgccagtggatgatatttatgaggagaactttgacgcagaaggtggaaatgtattttccgtagaattcctgccgggacagttcgaccagagagcggattccgcagagcagtgtgtgaagcttttaaatgaggatgaggagccgatcatccgcagcgcgacaacctatgtgatcaagggtgacatcacagaggatgagttagaggcgatcaaaaagtattgtatcaatccggtagattcccgtgagaccggtatggacaagccggataccctcgtacagaatttcgatgagccggcagacgtggcagttttcgacggatttatcgacatggcagaagcacagctgaaggaactgtacagctccttaaatcttgccatgacctttaaggatttcttacatatccagaattacttcagaaataccgagaagcggaatccgtccgtgacagagatccgtgtgctcgatacctactggagtgaccattgccgtcataccaccttctcgacagaactgaaaaatgtaaagtttgatgaaggattttatcaggcaccaatcaaaaagacttacgaagaatatctggatacccacaagaaactgtatgcgggacgcgatgacaagtttgtctgcctgatggatctggcactgcttgccatgaaacgtctgaaaaaagaagggaaacttgcagatcaggaagaatctgacgagatcaatgcatgttccatcgtggtaccggtggaagtagatggaaagacagaggaatggcttgtaaacttcaagaatgagacacacaaccatccgaccgagattgagccgttcggtggtgctgctacctgtttaggcggagccatccgtgatccgctttccggaagaacttatgtgtatcaggcaatgcgtgtgaccggagccgcggatccgaccgtatccgtaaaagatacgattgagggtaagctgccacagaagaagatcgtgcgcgaggcagccagaggttacagctcatacggaaaccagatcggactggcaaccggatatgtcaaagaagtttaccatccggattatgtagcaaaacgtatggagatcggtgctgtcatgggtgccgcaccgagacgtgccgtacagagactgacctctgatccgggagataagattatccttctgggcggacgtaccggacgtgacggtatcggtggagcaaccggatcttccaaggcacataatacagagtccacatcggtatgtggtgccgaggtacagaaaggtaatgcaccgactgagcgtaaactgcagcgcctgttccgcagagaagaagtcagccatattatcaaaaaatgtaacgatttcggtgccggcggtgtatcggtagccatcggtgagcttgcagacggactgcgcgtgaatctggataaagtaccgaagaaatatgctggtctggatggaacggagattgcaatctccgagtctcaggagcgtatggcagtggttgtcgctccgcaggatgtcgagcagttccttgcttatgcaaaagaagaaaaccttgaagcaaccgaggtggcagttgttaccgaggagccgagactgatcttagagtggagaggaaaagacattgtcaatatttcccgtgcattcctcgataccaatggtgcgcatcaggaagcagatgtcgaagtcgagatgccaaaagaggaagacaacttctttaaaaagatcgaacttccgaaagttgcagatgcattacagaaaaacgacaacaaatcagcatggcttgccatgcttgcggatcttaatgtatgttcccagaagggacttgtcgagatgtttgacggttccatcggtgcgggaagtgtctacatgccatacggcggccgctatcagctgaccgagacacagagcatggttgccaaacttccggttctgaaaggaaaatgcgataccgtaaccatgatgtcctacggatttgatccgtacttatcctcctggagtccataccacggatcggtatatgccgtgctggaatctctttcccgtatcgtgaccgccggtggtgactacaagaaagtacgcttcaccttccaggagtatttccgcagaatgagtgaagatccaaagagatggagtcagccgtttgcagcactgctcggtgcatttgatgcacagatcggttttggactgccgtccatcggtggaaaagattccatgtccggaacctttaacgatattgacgtgcctccgacactggtttctttcgcagtcgatgtggcaagagaaaaagacgtgatcacaccggaactgaaagaagcaggagataagctggtactctttacgatcgaaaagaacgcgtatgatctgccggtatatgaacaggtgatgaaactgtatgacaagattcatgagctgatcggcaagggcgcaatccgcagtgcctatgcactggacggaaaaggtctggcagcagcagtcagcaagatggcatttggtaacaaattaggtgtcaccattgcagaggatgtcacagcagaaacattatttgcaccgggatttggtaatatcgttgcagaagtaaaagaggagtttcttcctattataaaagaagcatccggagttgttgtcggtgaagtgaacgatgcacagaaatttgtatacaaagaaatgtcactttccatggaggaagcaattgcagcctggaccggaacactcgaaagagtcttcccaacccgcgcaaccgagggcaaggaaaaagtgcagagtgacgtatatgataccaagaatatctatgtatgcaagaacaaagtcgcaaagccgaccgtattcattccggtattccctggaacaaactgtgagtacgacagtgcgaaagcgtttgagcgtgcaggtgccaatacaattgtaaaagtattcaagaatctgagtgcagcagacatccgtgattctgtcgatgaatttgtcaaggcaatcaaccagtcacagatcatcatgttcccgggcggcttttccgcaggagatgaaccggaaggatctgcaaagttctttgcaacggcattccggaatgcaaagatgaccgaggcagtaagcagactgctgtcagaacgtgacggactggcacttggtatctgcaacggattccaggcgctgatcaaactgggacttgttccttacggacagatccaggcacagagtgcggattccccgacactgacctacaacaccatcaaccgccacatcagcaagatggtatataccaaggttgtgacaaacaaatccccatggctgcagcaggcaaagcttggtgcaacatactgcaacccggcatcccatggagagggacgtttcgtagctccgaaggaatggctggacaagctttttgcaaacggacaggttgccacccagtatgtcaatgaagccggcgagccaaccatggatgaagagtggaatgtcaatggttcgtacatggcgatcgagggtatcaccagtccggatggacgtgtactcggaaagatggcacacagcgagcgccgcggtgaggccgttgccatgaacatctacggagagcaggatatgaagatcttcgaatccggagttgcttactttaaatagaattgtttatcttcacgcgtagtttcactcgaactacgcgtgaaatagttttaataatagaaaaaagtgaaaaaactcttaaatgcttaagaaaatattaaagaattttttcaataaaatgtaattttggtgttgcaaagatacaatacttggtgtatgattgtcacgtagagtagttaaaagagtactataaatagtacgacaagtgatgaactactatcgaggctatggaaactggaatttgttccagacagaccttacaattacagatacatattagaaatataagtcatcggaacctcagcttgctgatcttgatgctggacaatcaacgttgatatcacactctacgccgacgtctgatgtacgaaagtttctagtcatttatgatttgtgtgtctgtagatgaaactgacgatggacttaacagtaagaccgaggaggtcagtggaggcaattagcgagaacattggattggaaaaatcgtccgcagcggtttgaaagagaagatgaaggaacttaaacgtgcagggttaaacgagtagaagagatggaagttagtcaaaaagaaagagaggaaaaaacatgaaatcaagcaaaaaagtgttagcttttgctctcgctgcagctatggttgtaacagcagttcctgctacaaacgcacaggcagcttctacagcaaagcttagcgcaaaaaaagccacagtttattctgagggctacaagacagttacagttaaaactccaaagtcttggaagtctgttaaagtaactgcaacaagcaacaagaagtctgttgcaaaagttaagaagacagcagcaaagaagatcaaggttacaggtgttaagccaggtaccgctaaagttacggttaaggtaacttacaagacttctacaaagaagagtgctaagacaaagacaaagaaacttacttacacaatgaaagttgctaaggtaggcgttgctttatctggagattcagtagtagcagttggaagcacaactaagttaacaaatactaagaaaaattcttcaagagctaagattacttacacatcaagcgatgattctatcgcaacagtagcagctgacggtacagtaactggtgttaaggctggtaaggcaacaatcacagctaagattaccgttggtaaggattcagctgaaactactaaggatgtagaagtaaagaatgttattttagattctgttactcctacagaagcaaataaagttgttgctattgtaaaaggtaataccaagaaccttaagaaagcagattttgttgtaactggtactgaaacaaaggcaactgtagctgttacagacattagtgttgatgcaaaggatgctacaaaggttactcttactcttgcagctaaactgacagatgcaaaagagtacggagttgcattagacggtatcacaaagacatttgtagcttctgatggaaaggttgattctatttcagttgatccagttcagatcccgtatgctgaagcaacagaaattgaccttttagcaaaagatacaaagggaattattgtgaatagaatgaaatggaacaatccagatgctggattttctttcacattcacaaaatatgatggaactttacagggtgagaaactttacctgaataagattggttctgttgcagaaggaaagattacttatacatcttctgagtataatgcagatggaacacctaaggtaaaactggagcagccatttacaattactgctgttgatcaggcaactgttaacaattatgctgtacgtcttggaaaatctactgacaagtttgataagttgaaagatgataataaacttgctgttgaagataacaaatatgcatttatcaaaatcaaagatgcaaatgacaaagaagtttctgattatagcaaatacacagtagaaagttctgataagaatatccttctccttggatcttcttcaatcaacaatgcagaccataaggttcaggttaaagccgtaacaactggaacagcatatatcattattaaaaaagatggcaagtattgcacatcccttccaatcaatgtggttgctaagagagaagcagcttctttaactatcgacaatgctgcatttaccttatctaatacaacaaaaattgctgataataaagttgtaactgctaaggcaaaagaccagtatggtgatgatatcacaatcggtactaatgctctctcagcagaatgtgtatatgttgatgctaagagtggttctgctgttaaagtttcagatgtaaatactaataatgctaataagtatgttcagaaaactgctgatgataagattacattcaagggtcaggttgagccaggtacttatacatggacaattaatctgaaagtttctgatactaagacattaaagcagactgtttctgttactgtaaagaatcttgatgatacaaagaaaaatatcagctatgcattagaagcttctgatagtgagattgatgctgttgttaaggatgatgccaagaatggtgattcttctgatgcaactgtacagattgctttatgcaaggatggagtaaaatctgattatcagacagttaattatactgtaaagaaagatggcaaagttgttacaggtgctggtctctctgttgatggtactactgttacagccgagaaagctaatggtaaattattaaagattacagctatgtccgtaagtggaaatgtcgcaacaaaacttgcagcaggaacttatgaagtaactgcagagtggaaggatactaataatgtagattattctcagaagactcaggttgttgtaaaggatactcagacaggtgctgacgcacaggttgtaaatgctggtgtatctactgctacaaagactactgtaaaagatcttgctgaggatacattaaaggttgttcttggagatacaacttatgtaaatgttgataagaagtcaggagatcaggcattaattatcacaaaaattgaaggaaatacaatttcagcttctggagatatcacaggtgtaaaagatcttgctcctggcgcagaagttaatatttctaagattacttttactgctaaaacatccagtggtgtatcttacgattatactgtatctgtaggaagaacagtaacaaacaaataattaaatttgttagaaagaggttgctttcgggcaacctctttttcaagtataaaaaaggatctgaaataacagatatatatttaaaatccgtaaatttgccattgcgtaaaataaaatccgaacctacagaacatgatgcaaatgaatttatatcagtaattcaagagtcttttggtaaatttaattcactcactattgagtttgaatttccacacgtttaaaggaatcagaattccaagtagtaaaataaataccaaaatgtcagcatttgggagtttgtcaagtaaagtgtgtaaattttttaattttttgtggtggtcgataaatcgaccaccatttttacgagcttcaatcaaacggaagttcttgatatccgtacttcaactattaagatttctgggcaaatggcaaacgcgtcattaatagggtagagggagaataattatctcgcccctcccattgaaccgtacgtacggagaattttgattattagacgtattttcagttgggttttagtttttcattcaaggattatagtggaacagacctgaacaattctgaatttggaggtgcatatatatgaatactgatatggatatagacataaacaccatgacagacacaattacttgcagacttgttgaagcgaggacagatcttggcattacacagaaagaacttgcatcagcaaccggcatcagtctgaaaactattgccaatatcgagtcaaaacagcatattccttctctgctatacgccatgagaattgcagatttttttcacaaaccggtaacaagcctgttctgctatcatcctggtgttcagcagactccatctaaaggagatgatctgaatgaataataaaaaaatattagatttccagacaatcgctgttgattttgatggcactctctgctacagcaaatggccggagcttggtcagccaaaccaggcactaatcgaatatctccaggaatggaaacgcaatggcaacaaactcattctctggacctgccgcgccggtgaagctctgtcgaaagctgtcgaatggtgccgggaacagaatcttgaatttgatgccgtcaatgacaaccttccggaaatcatcgaattctacggacacaacagccggaagatttcctgtgattactatatcgacgaccggatgctgcttccggaaaacgcaaaggcatagaacccgtaatggggctatgcctttgtgcttattctgtaatattcaattctatttctgctgccttggcaaattctttttttctgtccaacagttcatttttctcctgttcagacaggcagttgaaaatttcctcgtaacaaaaaaagagacggtcaatacactctcatgtactaaccgccatcaacaatccttctgctatctttcgtcattttttgacttttccatattcacttttttcttttcctgtggaatttgtttcgccagttttattttttctctcacagacggcttttccagttttttctctgctaccttttccttcagatactgttccgatgattccagatactctgccaacggtccagtcttgtcctccgtgataggattgatgtctactgcaatacctgcaatcgtaaatccatcctcatgcagtatattaaaaaaatcatcttccctgacggtacctttgtagtccaccaccacatccagatcagaaccgattttctcaattcctctgcatctgctaccggacagaatcacattttccacctgtgcatcaagattattttctataatttttgcctgcacataatatgacaccatttcttcaatctcttcgacattcattccgtccaccggatgaaaatgttcctctgtctgctcccggaaatcttcaattacttttgcagaaagcatattttctttctgtccaagttctgtccatagttttccaatcacatgattcaggttgggattatcattttccatcagttcaaaatgcatctcctgacagtctgataatgaagtcagtttctctattctattatgatagcttctgtactgcacttcatctaacagcttttcttccagccggaaggcttcacttcctgaaattctatcccagatatcattcttttctgctcggataacaagaccatatccatcatcatgcctctgctgtaccatgtgaaggatatccatttctccattgatcttgcatgagaaatcaaattcattataccctgcatcccagtaatatcctgcctgtgtcaatctgatatctgttacatctgctgccataaccattccctgctctatatcttttgtctctgtatttctatcttccatcctgttctccttttcttaaaatagcggctcattaaggccgcaatcgttgttgcttcgcaagttagcaagcagtgcccccgtacgtacacgggcgcattttgcttgttggaggcacatccccaatccccttagaatgtcatcttcgatgacaaaccgcgccctcacttcgtgagtgctgatacattcctgctctgccggaatataaaaaaagagagcaaccacccatttgtatttttgatgattgctcgtatgcttacctcgcctgctgccgtttctttttcatgtcttcctctatgtcccagctctgctgagcagcatagaaggattccacattttgcttcgctatctgataatcccgcatttctttttttattttcttgtattcgctgtaagctgcctttttctctgaaagcagtcttgcaaattcttcattcagatcctttacctttggaatctttccatccggcagttttgaaaatgcttcctttgctgccttatgaagagtaatctcatcccggtgtgcctcgtaaaatttcttactgtatcctgattttcggtaggcaatatatgtttccctggtcttggcataattgataatgtgagtcttgatcactttatttgctgccatcttctcctctgcatctttgatgtttttcatcagttcatggtattttgcagaactcccatccaccaatgcatccagcgtttccttatcgtgaatatcatgctgctgtaaaaacagaatagattccgcaaactgtttcacattatattttttcgcccaccggacatagccgccgttctttccctgtgccattttttcctgaatatcaactaccagatcaaacttacgcttttccggttttgcttctttccgttccggcactttttcatttttttcaggaggctctttctctccggcaatcactattttcagattttcttctgtaaaatcctctccaagtgaacggaatcggatgaaacgtttctgttctttcccacagactgcggtatgcttaccacgcttgatctcatatccttctgcctgtagaagtttcagaagttcttcaaaatctgccggcttctgatccaggcatttcagaatatcttcccggataacatccctcatgctcacacgttccgggtactttgttctccgctgcctctcactcggctttacctttggaatgacagaaagcccatgctccagacagataatgtcgctgagtctctgcaatgctattccggaaaaccagaaatcccggaacttccggtcacattccagattggtggaattgaaaatgatgtggttatgaatatgcgcccggtccacatgagttgccacaataaatgcgtgctttccttttgtgaatctcatgcctgtttcatatccgacttcgtttgcttcctccggtgtgatttctcccggtttgaaggactggcggatctgatatgcaatcacatctcccttaggctgccgccatgttttatgcagatattccttttttgcctgagcaaattccagatcaaccagctccggattacactgataagacgaaatgtatttgccctcatccgttttgtctccattcatggcataatcggtcctgtctttcagacaccgcatcacactccggtctttattctggtgcattgctatcagttttgttgccgccatcttctcacctgccttacataattgctgtcagtctgtccaacacttttctcatttcctgcaaaatctctttctgatttgttttcaattcttcgatatcctcatgataaatgctgcctgtctcattcgctttctttgcatactgattcagattattgccggatatctgtaaaaggcgaagaacttcttttaagtcagaaagatccatcacaatgacatatccatgaagtgccatccggatcatatatgcagtgagactggaaataccagcctcttgcatacgctcatgaatctgcctgagttcatctgctgtcactctcagctcaattcgttttgatctttctaccatccctggaactctctttcaaaacaacatcccggaactggctttctatcagaaacaggcacagggaactgcatctgtttcctctgttcctttaatttttccaatacggattttttatcatccggtacgatttccaaagtgcctgctgccggttccactttcacattattgatcacaccatcaaagctgttgtcgttctgctccaccatatcctcgatgctcctcatcggatttctgctgatggaggggctagctccagccacttcttccggctcacatcctccggtattgtccgatacttccacctcatgctctccgtgtacttcatcccattttttaatctttcttgtttttgctttttccatatttgcctgttcccttctcaaaattcagttcaaatactgctctctggttctcatcaactgtcatgatgaccgttgtatcataggtctttccggtcttctttgacttacagcctttcagtgccacttttccatcggaaagaagttttacagctatcggctttgtcatctttttgccaagagcttcaaagaatcggttctgcttccacaatacaaaattacactgtctgttctcacaggaataacctttctgcctctcgactatatgcctgccacagcaaggacatgttccgatttcttccagtaccggatgcatgagcacttctgcatcttcaatgatcttataagttctgaccagttccgtgatcatctcttcgatttcgttcataaactctgcatcctggaatgctcccttctccacatccagaagtttctgctcccattcagctgtcatggatggggacttgatctgctccggcatgaccgtgatcagtgcaactcccttatgtgtcggaagaaggtattttgtctttttgtttcctttacgttccacaaatccgatacggaccagcttctcaatcgtcgctgccctggttgcggaggttccgattcctttcctctccacttcatccggcatctcatccgctccggctctctccattgcagacaataagctgtcttctgtaaagtgcttcttaggggtggtctttccttcttccatcttaggattctgtaatggataagaccttccattggtcagagttgcaatgcaggccagcatatcagcattctcacttttttctttcttatcatcttcagaatctgtgctttctgcgctgcttcctatgatccattcctgaatctctctccatcccttttccctgatgttctttgcctttgccctgaatactgtatctgcacaggtaaattccacatccacttcatttctcactgccggatctcccagagcagataacagtctggctgtaatcaggctcaacaccttctgttccccagattgcagttctccaaactctgtatctgccacattgaccgtaggaatgattgcatggtgatcactgaccttgctgttgttgattacctctttcggatgaatcaccatttttctcgtatatccaaattttgcagccatctttcctgccagatcaggaatcatgctttccatatcttctgtgagaaaacggctgtctgttctcggataggttaccagtttcttttcataaagactctgtgtataatcaagtgtctgctgtgccgtgaatcccagaaaacggttggcatccctctgcaacgctgtaaggctgtagagctgtggtgccttctcctgcttatctgccggatcaatctttgtcacctgtgcggtcttctgttctttcaacacattcaggatattctctgcatcctgtttcttctcgaaacgatctgataatgccgtaatgcctccgcagctgatggacagtctgtaaattggttccggcttaaatccatcaatctctgcctccctctgtacgatcatggcaagcgtcggtgtcatgactcttccaacattcagtgtctgtccatacaaagttgaaaataacctggttgcattcattccaacaatccagtccgctcgctccctgcatagtgccgcccggtagagatcatcatattccctgccatttttcagatgagaaaagccatccgaaatcgcctggtcttccattgaagaaatccataagcgctcgaatggctttttgcattttgcctgatcatatacaagccggaagatcagctctccctctcgtccggcatcagtggcttccactaatccggttacatcctctctttctatcagttttttcagaattccgaactgctttcgggttgcttctgcaatctggtaattccattctgatggcaggattggaagatcctcatatctccacttttcatatttctcatcataaaactccggtgatgaaagctccaccagatgtcccacacaccagctgacaatataaccattgccctccaggtagccgtcctctctcttatctgcaccgattacctttgcaatggactgtgccaccgagggtttctcagcaattactaatttatatgacattttgctcctccttttgtggtaaaaaaatagcaccttaaccattttggctaaagtgctatgtaaatttgttattaaattgtgtgtgaatcagacaaacttgaagttgtcaaagagaattgttccagtattccacagtattgccattcacatcatagaatgtaatggttcccgcatttataggcaaaacaatcgcaaaaggtttattgctgtcaatgtcaagcacttgaattgtgttgccgtcatctatttcaagctgtgttacctgttgctgattcatagaaataaatgctcgctcattatatccttctacagtgtactcggcaattcctctttgaacccccgaaagttttccacccccacggaaaaagtatccaaaggaaagaccagggcggttgacatagacggaaaaagaatggtcactcaaatcctgagggtaagaaatatatgcagccatcgtgctggaaacgcttccatcgaccgtccaatcatccttaatcttctgcgacgaacgaatatctgtctccagcttagatgaagtcacgccgatctcattgttcgtataaagaaaacaaacaaataaaatacaaacaagaacaacccctatcacaattttaagaaatatttttttcacgctatcaaaactccttgtcaacttccgatttgcaaatttcttttacttattatagcacataacatatctacacaccagcaaaagatcgataatctctatctacctgttgaaccaaaggacccaattccacgctttttccagttctcaaaaataaaatccggtatcaggaccggcatgatcacaagctgtcctaccttgtcaccactcttaatctcatattccctatttccaacatttgaaatgattgcatgaacctcccccgtatatccggaatcaataggtggcagctcgcacacaattccctgtgaacttaatccacttcttggaaatatgtatccggcatagccatccggtatttttaatccaaatcccagaggaagcttacagatatctcccggccggattactgcatcctttggactgaatacatccgccccggcatcattggcatgagccctttccgggcttctcccaccaaaatcaatcagctgtatcttcatctgatactccttcctccaacgcactctcttcgcacagttttggaaaatccaccctgataatatctgttggtaacatctgcggtggaataatctttccacaggtcatctttccttcctcacagccgccattcatacagaatggtccacagtcagaaaacagttccctgttctgctccagaagctgtttccagattttcaccatcacatatctggtctcctttgtgtttctcctgcatgtcctctgacggatcatgtgcttccactgatacggtgtcgcgccgatcagaagaatatttctcattccctgcggtgcacagtatccggcagaatcattatcaaccccatatctgatcatttcctggtaatttttcattgccatgctgcactgtcttaaatatccttcctcctgtccggttcctatcagatcatagggaatgacaaaatcctccactcctgaatagtcactgtattgcaggcttgccgacatatatttcacttcattctggtgcctggtaatctgtgccaggaatcttctggatgcaccgactacaaccacattgatgattccaaacttctggattgtcggatgtggcagcttcacaagatttgccacggtggatctctgatatggcttttcatacagatccatgaaatcatctaggcaggaaatctgatgtcctctctgagtcagccttgccgcacagaccatcagcttctctgcctggtcaatggattccggatttaatatcttcacttcaattttcttcattcagttcctcctctacaatcgcacaaagaatcaggaaatagttaatactgtcggtgatcttctcatcccactgttctttggaatactgctgctcacccatacacatatccgatacagagatcagatgcttggacaacattcccataagtgctgctttcggtgtggtattcatcaccactgctgccttcttgaaatgttccagcctgtccactgccatattcttcactgctccgggagcatactctgctccctttgccaccagcatggatttacaacgatccgtctgcctgatgatcacttcattgaactctttctggttcatgccctttcctccttcactttcgatgttctgcttttcttaggtgcctgctctgccttttccgtattggatttcagctttgatttcacagactcctttacctttgacagagtccttttcttatcaagatccttcagggtcttgtcaacaactacctttaattccgggttggcagttttctcttgtgcttcaggtacaaccggaataaagcccagattctttgctccttctgtaattttgtccataagctcctgtgtaaacggactagatgtttttgccgattcctgcacctggcccttatctgccatcagcacttccatcttctggtcaatctgatagatgaactccgatgccgtctggcggatcttatcaagggatgctttcagctctggtgtttcctttccctctgaccagcccgcgacataagaaaaggaatagtcagaagtgttgattccgtaatgctggcatactacatatgcaacactctcagcctcaacttctttcccattccttgaaatgtcttttgcctccggcacattatccttgtcatgtagtttctggtgcgccatttcatgaagcagtgtcttaatggtctgtacctcactcatgccatcctgaaccacaattttcttgtcttccagatgatagaatcccttggcatctccatcaatcagctcaaaagataccgggaccgggctgatctcctgtagtgcctgcaagagcttgggatatccttcaatatttcccaccagttcagaaggaccaatggtaggaagttcttttccgtctgtctgggacaggtcaaatgtctttaccaccttgaatgcccggatcgtgacttccactttctcctttaccggttctccgtcagcatcaaataccggtcttcccttttcatccagttttgtctgttctctctcaatcttataaggtgccggggcaaggatgctgattcccttttctccctttttcacataccgccccatctgcttccaaccggtaaaactctggcacagctgtgcatccggtttctgcatcatgatcagaagtgaattgtttacggaatatcttggaaatttcgccatcgtgtcaagaaactgcttatatctgtcactctggaacacctccataactcccttctccagtttgtccgttatctgctgcaattcatccgtccgcttatccctggactccagccagtcgattttcttctgtatgctgtcggggatctgtcccacaacttttacatccggcatctcatggatcagtgatgcaatcatctgttgtgcctgccagttgtctgcaatctccggtatataacgaagcatatccatgtcaatccttctcccgatcagtacatccatctccgtatattcatccggatcctttggatcagccgccctgattccgattgccggaactccgtgcatacgctccggtggaattgctttgaattttgctaccgcctctgccacactcttgatattctcatgaaattcacccatgctgtgaaattccatgcattccgcaaccgtaagcgtgattaccttcttctcttcttttacagccgtattttctgccactctaaatccctccagttctatatcttccagattttttgtcagcttcaatgacgctaaaggcatctggtttttctcctgaaatgaataaaattcatttccaggtcccactatgatgtggtccaccaatttaacacctatcaaatcacaaatcttattcattctgtcagtcagaccgatatcttccacacttggaaccagtctgccggacggatgattatggaccaatatgatagctgctgcattggacaaaatggtactcttaaggagctcccgtggatgtgcaatcgactggtcaagagctcctatacttgcaatatttatattgattggtctcatgtcagcccgcagattcactacagcaacaacttcccggtcataattccgaaacgtatctgccataacttttactgctgccgccggaccattcatcggttcctcactgaaaagaggcggcatttccaccatacggatagccacctgattcagtcgatgcatttcttttttctccggttcctgcttctccacgccggcataaaattcctgtttcggacgaattccgctaatgttcatcctccgctccttccccaacaggtatgttcattgtgaactccctgtttttcatactcctgagcttgtccagcaaagattcttttgtagatgtcctctcatgcttggaaatcttctgcaatctcttcatatatcccagatatctgctttttcttgccatactaccgctctcctttcttcttttgctgtccctgtttcttcggcaccctggccgcttcttttttcttttcatgcagatctgctatcacagaatccttaggttctgccctctgcatcctttcctttatccttcttatctggtctctagtaagcggtttctccacgatactcctgtggaggattttcccaatcggaagccatgtgacatcctttccagccttttcctgctccatgatgaatttcatatgtgatgcagaaaatttaggattcatgtaatgctccaggttcagatctgcctcggctgcttcatagattaccttgatctgtgccggcttgaactcctccgacacccttccggcatcttccatagcttcttcaacacgtattgatgcaacagatctaaatgtataatccacttcaacaaatccactgttataatcatctactgctttctgaaatcttgcctttttctcctctggtgtgagcttattaaattccttgtcttccatagattcctcccatcagaaaaaggcagccttacgactgcctcattcccttgatgctactcttcatccatctcgtcctgatcatcttctcctgtatcttcttcagcagggctttcttcctctgcatctgatacagactcttcctcaatgtccatatctgcaagataatcctcgtcatcatcactgtcgaagtaatctgcatccggatccggtgcatctgcttttttctttcccttattggacttcatatacataaatccaccaataccaccaatggctgcgatcagaaccagtgccataattcctgttacatttttcttcttaccggtctcaagagcttttgcctcttcctttggctcctcagagatttcttctgtagcctctgtactttttacttcctctttctctttctccgaagcggtcattccctgggaattcatataggactccacctcatcatcctccatgagcttcaaaaggtctgattcatcaacaagattcaggaaatgcacggtctctgttcccttatcatcacggtcaatgatgatatagaaataattgccggacttggttgtgaccgtaatgaactgcttgccacctgcctcaatggaaccgtaatcatccaccagattcatatttccatccggtgtaagaggaccgtagttttcctcggctgtctcagtacattcctctgaatcttctatatgtgcatctacaccctggcagacattgtaatcataaaggcatactgcacattcctcattgatggaatcctgtgagcacttttcgtcacagatgcattctgcttcctgactctgtgcaaatacagtaaccggtgacacacccgcaacggctgccattccgattaccagacctcccataatctttgctgcgatcacgtttttcaaattattcattctcttcatctaagaaatcctcctcttccttatccatatctgtctcattgtcttcatcctgttttttaccggatgtatctgcattcacggctccgggcatcggaacctgtccgctgagcatttcctgtaatcttccactgtttgcaagctgtaagaactgtgccagctgttccggtgataaattataggatgcaacatcactgacgatctgctggttttcctcttctttcagctttgcttccagctgctttacctttgcatccgctgcctctcttttggctactgcctttttcagatcctcgcggagcttatctaactttgcatacataagcgctctcctttcctttgtgacagcaaaaaagccaccactttggtgactttcgctgcattcataattactggattcttccatagcaataggcatgtgccctccagtatggtgtatcatatgacgcatactggattggattgccacagtgaatcatgatcttatttaccggatcgactacaatacccacatgggatgctccggcagtgttataggttccctggaaaaagaccagatctcccggttttacatcggaagctgccactcttgcggttgcattcttccagccatttgccgtaagcctgccatagttccagccatttccacaattattgatgacatagctcacaaaaccagaacagtcaaaacttgtacccggtgaggatcctccccatacataaggatatccaagatacttttcggcttcccggtgcatattggaaaactgctggtccgtcaggtattctcccggtacggcatatctctcatattcctccgatacacccggatttgcatatacattatccccgaagatatccggtttgttgcctctggtctccagaagcagcgtataccgttccatctgatcctgcgtcagattcagtgcactgacagctgcggatattccattgttggtcagcgttgtattcagtatcttgtactcatactccacttcaacctcataggattcatatacctcatatggaactgacacggtataggtataggattcaagacgtccgtttaccaggcggtatccggttctttcctcatcccggtaatgtgtcacataatgccatctggtctctgtcctggttctgatctccacaacttccgttgatgtcagcgtatactgataatcaaagatggtctgtaattttgactgaacctctgacggtgtatagtcctcatacagaaccgtcagcagtgccgccagttcaaaaggattgtgggatatctctgaaagtgaataattgtattcgtcatatcctggatgatctgtctcaatgctgtccaccttattctgcagcaccgtctccagtgccacataatctgcttccacctgcctgatatcatcatcctcagcggtaaatgaagttgccacagttccactgtttatgccgcttccaagagcagaacaggatgtcagtgctcctgataatacgagaacaacaatcagaattgccaccgctatgatcatgccgatcggatggtcttcacagaattctttcagcatctctgcaagccttcccatcaggtcctccgcctgatccgtcagctttttgctgatctttcctgccccgtttgcagcttcctttgcctgcttctttgctgccgcctcagcaaattccctctgcatcagctttttgcgtgttttcttcacggtagctgacatggtgctttctcccgcctctccggcttcttttgctccttttgctccctgcacggcatccagatggtcactgcggttatggattttggaagaatatttccttgcctgtccatgttcccgtacttttccaatgcctgcttccactgctgccagtccggcattcaggctgtctgttccactgttgtcgtcctcatttttaatcgtggtttttcttaccgtggctgcaacggcctgatttttatatatcctccttctcccctgcttcttcatgctgcgaagttcttttgcttcgctgactgaaagcgaattatcctttttcccataccggatcttatcacggtaactcctggctgccgatgaatcatttttcagctttttgccgtggcttttccctgcatggatatccggattcacttttttcttccgggtggacttcttagcagaattccttgtatatttttcttcattcatgctctatcctttccgaagaaacagcctctacgctgactgttccttctttgcatcagccacttcggacagtctggttgtcatgatacggtaaagttccgtatttgccgggaatctgtccacgaatggaaggatcacatttccatagaataaaagcccttcgccttctcccgaatgtgttacatacgaaagctggtgagggctgatatttaactgcttagcaaggatctgtctgtcacctactgcctggttgagcatatagatgaaatcagagttttatagtgataggtaagcctctgatatcatctcgggcttttcccccactctggattgtgcttttcctttcgttttttgttccaactaattagccatgaactgcttaatgccttgtgattttgcacccggattgtcgtttccatatccctccaagagattgataacgccccaaatgcctaagcctgcgcccagtgcgataacaagggtctgtaatacgtcgatagcagagttaaaaaattccataaagctcctttctgccgcaaatgcggcttgccctataaaagggcataaaaaacggcggtcagttttcaaactgccgcggtcataagtccccgcgctgcctaaagttctgccgcgcggcggtattcagttgtcagtgtgggcgataggaatttttgtaggggcgcgtatcatgcaagttgtctttttctttgttactgcgtcaattcctcctttcttttcagccgggaacacacatttttcgtcattccaaaagatagctcctacgctgcatatactcggtaacgtaaagggtctgttcccctccgcgttcctgcaaatactcccgcagagcgttttctgcattttctatcatctttgtaaaataatgttcacgacgtatatcatcagtttttgttttctgtctgctcatagtataacctcccgtaaaatcaaagttcccgccgcacccgtttctgctcatacagggcttcacaccgtttcacaaactgctggatagctgcctgccgttgctgttcccgtcgctcggcaatgaaaacaagcccgtttatggcttctgtgattttcttatcttttttcttctgcatacgtctattcatggtcggtgtcctcctgcaaatctgcttcgctgatttcgtaatagtcaaagggttcgtccggctttacaagggcgggtctgcgccttaaatgcttttccatatcaaaggtatttttcttgtcatagtcggaaagatatttatagttggggtgctttgtaatgtcatacttatcagagaagaacgggcgtacccctcgtagttgtaagatacatttcccgccgtccatgactgcaatttcatcttcggtcataagctgcttgcctaacttctgatagttcagcccatgtgatacctcacgcccccggttctcggaagtgttgaagctgtcaatggtttctttccccaagatttccgacatttctttgagggtggttttctccttgccgcccaagaaaagggtggtgtcgcagttgccggctatggtatcggcgttatctttgtatatcgcctttagctgcgactggctttgcagaatgattgaagcagagatttcccggcttcggatagtggctatgagcttttcaaacttcggtatctgcccgatatttgcaaactcgtctaacagacagcgtacatggacgggcagcctgccgccgtattcatcatctgccttgtcgcaaagaagattgaaaagctgcgtgtaaagaatactcacaacaaagttaaaagtgtcgtcggtgtcgctgataatgacaaacagggcggtcttacggtcgcctatggtatcaagttccatttcgtcggtttccataaggtcgcgcagctctttaatgtcaaaaggggcaagccgcgccccgcaggaaatgaggatagagcttcttgtctttcccgcagataacaggaatttcttatactgccggacagcaaagtgttccgggtctttttcctccaaccgttcaaacataaggtcaacgggggactgaaattccgggtcgtcctcgcgggcttcactggcatttatcatttcaagcagcgtcgtaaaattcttttcttcctccggggcttcgtaccaaatgtagccgataagggcgcagtaaaagagccgttccgattatagtgataggtaatcctttgaagttatcgccggattttcccccactccacaccggacgtgcgactttcaccgcatccggcgttccatcggttgttttcacaagcatttaatcaatcaccaaatgaaatgttagttttctattgcggacaaaccagcctgctggcgcagactgttcacttttaacatcagttcctttgttgccttgagcgtgtcggctatctcttttagctcattcttaggacactcttgcaggagtggaagaaatctattatggaacaaaatcatatttcgatagcgttccttgccgcccaattctgccggtgttttcagccagcatactatgtcagccgcattttcaaagagttccccacttagcgcacattttccacgttgagccgagaatagtgaaatcctgctgtcagtaagttctgtgcttcgccccatagacggttgattcctcaaacctgatagaacagatgagttcatacttaggttcgtgtgtatcaatgcccgtccctctaccgtgtaactgcaaaccgccgctttctttgccatcggtatcttgttcttgatgtatgcgatagggtagataggttggtcgattccagatacataccgtatcattgccgactttccaaaccgttctttttcgctctcggtcattgcgccgccctctcgaacaagtctgcacccggtttctgtattgagccgatttgttaaaactgtcatgacctgtctgtggattttcctgcaatcaatgctgatgcaggtggcaagttgaaaataattctgtattcccagaaccattgaattgtacagccgtatttcgtccaaaggtctttttccctctgaaggtcgggcaattcgtttcgcctgttccaccagtttttgcctttccagttccaactttttgtcacagatatgagattgcacgatgtacttcctgcttttcggtctgactcgtatcttaaacccaagaaactctgaatagcgttttctaacattgactatccttgttttctctggcgatacctccaacctcagcctctcggttatccatgccgttacagcctctttcgttctcaaagcgtcctctttattccggcagaaaattctgaaatcatctgcatatctcacgatatacatttctttcaaccctgttttcctcattttgaggaatgccttgctccggtcaaaagtaatcgagtttctgattttcctctcatacccgtattcctttacaagagggtggttctgccattggctctcaacccatttgtccagttcattcagcacgatattggcaagcaacggtgaaatgataccgccttgcggagtgcctttgtctggaatgagtgtagtgccgtctggcattctaatcggtgctttcagaatccgcttgataataaaaatcaactgcttgtcgtgtattcccattgcccatatttgccgcattagcttgctgtgatttacgttgtcgaaaaatccttttatatcaaactcaatcacataatgcaggttcatgcgttgaagcatggtgtaagttttctgcacggcgtgttccacggaacggttcgggcgaaagccgtaactgttgtcgctgaatttcgcttcgcagattggctctatgacctgtttgatacattgctgtaccagcctgtcccagatacagggaatacctaacggtctggtttttccgtttggtttcggaatgtctttgcgtcttaccggctttgggcggtatccgtgctgacttcctgtgacaataaacctcactttctctgcaactgtttcgggcggtaaacacccgatgtcactgatgtttttgttgtctgttcctgctgtgtagcttcctccgtttgctttgatgttccgatatgccagaagaatgttgtcccggctcagaattaaatccataaggtcggtaaaattttctccctccaaacttcgatgatagagttcatcaaaaactggctgcataccgtaatactcggcatgacgtaagtcatctacacatagagttttgtttttctttggcataaggcatcacctcctttttgcgaaagtgacccttttggtcttactcgaatccttatgttggattgaataatgcctgcttatctcaaccgacttgtggccattcctccgtagctcacataacgcaagcacatcataggttcgaccactacttttcagcagcagttcgtctgcttattgtttttcgtcagactattccttgcggaatctgctgcctttcctcgttccgatagttctatctgttcatacatacccgtaggttcctgctatagacctgtcggcttgcctgtgcctgtaacacagcatggtcgttcgtaggatcaatttctactaaaccacaccgactgcgcattaacgcacccacacatttctgcgtggtcttcttttagacctgtacattcgcaggttcgtcagtccgcccgccaaagcgaacattctaaccataggtatcttatagactctcggcttataggtaacacagtctgcctccagaccgctttcgaccactttaggcagtggttacggttactctcagcctttgtcatggggcttcgtacaccagccattacagctaatgcacgcccatcaagggtaggcgtttcagggcgttaccccgtcattccacctatcagactaccagttctccgaacaacggaaaaccgttgctcgtgcgcagactttttaccgtctgcgaacgagtcgcacttatccaaaaatcttcccctgctttttccccgtcccctttggtgttggcaatcaaagtatttaccagtttcaaaatgtctttttcgctgcggagataggcaaagggattgtatttcatgctttttttgaagtttatcgtgttcagcacctttatccgatacccgccccgctgtaagagcttcccgcactcgactaaaaccgttcctttcgggtcggttacaacgtagcttgagtgcatttgcataaggttgggctttacgaaaaatctcgtcttgccgctgccgcttcccccgataacaaggatatttttattccttgcatactttggctgctttgggcggctgttcatggtaagccgttccgtctgtgtgagcagcacgttattttgaaataccgggtcggtgtagggctttatatcttcggcgttgccccaacgggcagagccgtattcgatacctttccggtatttcttcgcattcttgccttttacatagacaatcagccggataaggacagcccctacaataccgataagcaaatccataggtgcaaggctcggaagcgggtttgcaaaggcagcggaaaagccgtctgcaagggaaagcaccttgccggacaggtcagcccccggagagagccgcaccgcctgtccgattttgtcaaagagatagacaaagagcagatagggggcatttaggataagcagctttttaagttccggcttcatagcgatacctccctgtcctttttcttcactttttccctctgtgcgttcagagccgccgccttttctttgagggaaacaatcagcttgcggatagagggcttttgttcctgcgtcagcttctttgcggaaaactccttgaaagctgcggtcagtgcgtccgcgtcccgtcccttaaaaaacacaagatagcggggcggggtttcggtgctgtctttctttaaggcaaagtcaatcccgtattttttcgccgtactctcaaaggctttgatattgtcctttgtgatttcaatgttggaaacgcccgcgttctgcttcataagctgctttagggtctgcttgccatgcgggattttctgtttgtcatgctgctttttcatctgtgcaagcagggctttcatagccttttggagctgctgcgcggtcagctttccggtcttgatgtaaagggctatggtcttttcgttggtttcctcctgcaatgggtgtcctcctttcgtgttctatggtggtatgcccgccgccgggaaacgggacgggcatgaaaaaagagcatccgctttcacgccgccctgttaaatccgtacccgcagcccggaaaggtctgccgcccgaatacccacaagataccagttgtccccgtactccatacgggtcggcttccatttgccccgcacaaagacctccatgcagtcgccgcaatgcaatcccccgtaatagtcgtttacgtcaaagcgaatgtcgtagcggtcagcggtttcatcaaaaatcaaagctcctgttttctgtgtcatcataaaatcctcctttgggttggtttacaggctttcgccctcgttgcaggtgtaatcgggtatgcccttgcttcttgccgactggatagtgcgcccgccgtacatatcgtgagatacaagggacgtgtaatagctgccaatcgtagacggagcattgaaaagggcagctttcatgtactgcttgatgttgcggattttggtggtgttttcctgcatacagtccagtacaaagcggatatgttcgctgttcagtttcataaattttgcttttacaagctctgccgggtggtcgtccccggcgatacggattgttcttcgtttggtgcagacggtttcaagaataagggcaaggatttcctctatcctgtcccggtcaaggtatctgtcctgtatcagatagtcgtactcgatattgtccttgatgatttcctcatacacgctgtatgcgtctgtcgcttcctttcgcttccgttccggcagctgtgccgcgtcctctaagggagagggatttagggaatggaaaggaatggaatgggtacttgatatatctgtatttaatttttctttttttggtaagttagttttttgtatctctttatttaattgcgttggattttccgacgtcgggttatccggtgtcggattttccaatatcggcttatccgctgttggattttccaataccggacaatccaatgccgggggctgtggctgttcgtaaatggtgtactcaatagcggtcattttgcctttctcgtcgcgtccctgccgccttgtgatatatccggctttttcaagctcccatacagcggtgcggatagcgtcgatactttcccggttgataagggacagccctgcaagggtgtagtcccaatcttcgggaagtgagagcatttgcgacaacaagccctttgcctttagggaaagttccttgttgcgtaaatggtggttgctcataaccgtataacctttgttcttttccacgcggaaaactgccatagcttcatcactcctttggttggatttgttacgcagtagaaacgcggttttaagggaaaaggtatcaacccttgcctttctcatttccgcgctctaagagccgcataaatcaaggctttatttgcccttactgcgtaacatgagggcataaaaaaagcagcgttcctgttctcctgtgtgggagtgagaaacgccgccttataggtggtgcttattttattttttcttttcgacgtgccgcgtaaggtggtgtagtggtttatccggcagcttcgcaggtgcttttgcatatcaaggctcaattcgttaaaagtagtaaatgagtagtaaaatcaatctgcaaacctgcgaatatgcccgtaaatcaagcatttttcaagacaatcaactaatttagacataaaccaataaaatataacacaaaatgctaaagcaaacacaacaccaaaaacattttgaatcactctaagactaaccgctccttgtagtccataagtctctgcagcaatggctaaagcaccaaatgtgttaaatactgcctgccagccatattgtgctgaaaatcctacaccgattccaccaagaattcctatatatgcatagattgacgaaggaagcagaaaatataatactgtaaaacatataacacctgcaatatttccgacaatccttttacggactctgtagtgcatatcttccataaacggcaaaatcgcggacatggccgcaataccagcccacattgcacgtggcatattacaaagttctgcaatgcaaaggacgatcggtacgcataaaatctgacatatctgccattttgttctggaagaagtgatatcaaattcttgtatcagatctttcagatttcttttataagttctgtttttatgatttcgataaaatacgaagcaggtaagtgctgcacctaaagccattccgactaatcgcatctgatagctttttcccgtaacatcataaccatatagcagcagatacccaagaaccaatgtagattgattaaacatgaatggattatggcatccgaacagaatcaacacagccagtgccgcaatatttaacagcattccaagtaccggtgaaagctggtttgctaaatgcggacatacagtcataattacaaagaacaaagccaaaagcatcgtagattgtccggtgtggatccccagatccgcattccgaaataccataaggcataataaaactactacacccacaatactattctcatttccaaataagatactgaaaatagtaacaaataaaaaacaaaatgccattgtaacagctatcttcaccagatatacccacatatgatataatttttcttttcgtgtttcactctttttcaacagatttttagaacctgcctgatttaactgcaattcctgataaaatgtcatgtaattcctcctctatctgtttttcttaaacttatatggcctcatctttctgtattggaagctctacaacaaatctgcatccaccgtattcccggttttctgccttgattgtcccgccagcactatctacgatccgtttcacaagtgcaaggccaagaccatttccttctgctttgtgagaaccgtctgcctgataaaatttatcaaatattctggttttcacatcatcctctattcccggtccttcatcttccagaataaacattacagaatccttttcctgcttcagaaacatcataattgtcccctttgcaggactgaacttaatcgcattatctaaaagattcatccatatatgcataaaaagtccttcattcccagtatatttaacttcctccaattctacctgaaaaccaatttctttttctgtccattttgtttccaatgcaagaaatgcctggcggatctgttcatccagacgatattctgtttttttcactggtatgttctgattctctaacttggataacagcaaaatatttccaaccaatccggaaagcctttgagtattaaacaggattttttctacatattcctcttgctcctgagacagttcttctccctgaagaagcattgtatacccttcaatggcattaatcggggtcttaaactcatgagaaacattagatacaaaatccatctgcagcacctctgttgcacgaagctcttttgtcatcacattaaaactctgataagattctccaacttctgctatacggctgttcgtttccaaatgctgttcaaaatctccccgagaaacttccttcattgctttactaagcctagtaattggttccagtaactttgcattaataaaggaagtgatcagccctgcaatcaatgtattgaaaatcaaaagccagccaagcacaggtatgctgcccggcagattaaaaaaatgattcaaaaaagcaaataataaagcagatataactgttgaaaatacaagtgccagccagattgcaccagtcatacaggatcggatccgcaatcctttttctttcttttgttccattattttttcaccaccttgtatccaattccacgcattgttacgatttcaaaatcagggttatctttaaaacgctctctgattcttcctatatgtacctctatcgtatgtgggtctgcctccgtctcgtatccccatacttcatccatcaactgttgttttgtaaatgttctgcctggcgaagttgcaagcttatataaaagcaggaattcttttttaggcaaaacaagactttccttatcagttataaccgtcattgcatcataatcaaactctgttgaaccgatcacaattttgtgttcattcagtatctgtgcacggcgaagcagtgctccgactcttaaaaccatttcattcacatttaccggttttaccatataatcgtcacttcccgaaagaaatccctggcgcatatcatcaaaggaacctttcgcagtgatcataagcactggtatctgatatcctgctgaacgaagttctgacaccagttcatagccatccataaccggcatcataatatcagaaataatcagatcaatatattccttatccaatacttctaatgcctgtgctccatccgatgcacttttgacctgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttgttaattcgattggctctacatgatatggatcacgataggttccatcttccaatacctggcgggacactctttcatattccaccatgctctcttccaactgtttattaatatctttactgcgaattacaagcatcagttccgtatccagatatgcacttctcatgtccatattaaaggaaccgattacagacagatcatcgtcaatcagaatactttttccgtggtatgaataacctccttcatattcccagatattaattcctgtacttaagattctatttctgtttttcgcataatcggcagccccaaatggattcccattattcgcaactgaatttgtcatgatagaaaaatctgaaacgttctctgcaatctcctcccatgtattatacatcatatcattacagataatatatggcgtgtggatcttcacacgattttttgcatttttcatcaattctcccaactgataccacactactggttctttggaacctgtgtgaataggatttgacactaatgcaatcttttctgtctcaaaagtttcgtccgtgtaatcggtatcacagattctttccttattctcttcaaaatatttctgatagccgttctgcagctctaaaactgcgttctttacagattttctatttgccagttttttattgtcatgaaaataaccactgtcttcttgttcccatatcgtttcaaaatactctaacaactggttaactgaattttctttctcaggttcatcgcaaaccactaacacgtctctgtcatagttcttatgtcccggaaaatcacccaggaaataattgtatgtatttcttcccccaagaatatatctctttccatctgcaatcaaatatttatcatgcattctacccatcatcttccatggtttcaacggattggccttattatacagtttaatttcaacattctcatgggaagataatccatagaaatacggatttccttccatatcaatccagctctccattccatctactaacagacgaatatgtacacctctgtctgccgcatcatgcagtgctcctaaaatcaattttccactttcatcggattgaaatgcaaaagtagaaagaataatttccttttttgcattcttgatcaaacgcactctttgtaaaagcgcttctggattcttttctatgattactgcccgttctgtattttcactgcattcgttccatgacccattttttgtttcttttttggttgtattggacacttccggctgctttttatatgcaacgcagattccgagcaattcataaaaagccacacataaaaaaattgccagtataacaagaaggattttacatattttatactttttcattgtacatcacctgattcctttttatttcatacttatacaatacaaagtcaatctcaatttaacctcaacaaaatttatttttcataaaaaaatatgacaggcttctttttaaagaaacagtcatatttttattctaatatatgaaggagcttttcttactccgttgtattaatcactattttatttcttccataagctgtcggatttttctcaatgtacaccgtgtaactgccaggtcatcttcttgtatattcgatatgattttttcataagcttctatcattttttctttctgacaattgcttaattcaattgccttgttcgtcaaaacaaggtacgttctttcttttttttcatctaatttccagataatatatcctttattttcaagactttttaccatcttagatgtttctggaatcgataatttcatgtattctgccacttctgaaagatatactccttcatgacagtctgatttttcaacacattcctttatactataaaggaacaaataatctgttctttcgacaaattcaaatatactttcaacattgatgctctttaaaaaaaactcctctgcactggttcctgctcccatattatcgttcctctctttctatatattcttttttgctgactagactcttatatgccgggcgaatgatcttatctgtagttatcaattcttccaggcgatgtgcactccaaccagcaattcttgctatcgcaaataatggcgtgtacaattctcttggaatattcaacatgtcatacacaaaaccactatagaaatctatattaggacttactcctttgaatatctgacgctgctttgcaatcaacttaggtgcaatcttctcaatattgttataaagggtcatatctttctcacgtcctttatcccttgcgagttgttctacaaagcctttgaacaccctttctctcggatcggaaatagaatatacagcatgtcccattccataaataagtcctttctgatcaaacgcctctttcttcaaaatcttactcagatatgatgcaatttcctcttcgtcttcataatctttcacatgacttttaatatcatccatcatattcattaccatcagatttgcaccgccatgttttttcccttttaaggatgacattgctgctgaaataacagaataagtatctgaacctgaagatgttactacccgtgtagtgaatgtagaattgttaccaccaccatgttccatatgtaacaataatgctatatccagtactcttgcttccagttctgtgaattttgtatctggtcttaataggcgcaggaaattttcagcaatagataaatctttttcaggtctatgaatatacatactttcgtttttttcataatgacaataagcatggtatgcatatactgctaacataggaaatactgcgatcaactgcatactctgccttagcacattcggaatttcaagactttctttctccttatcgtaagagcccaatgtaagaatacttcgagtcatagaacccataatatctgatgtaggtgctttcataatgacatctctggtaaagttagtcggtagttccatacaatcagatagtcttccctgaaattccattaactgtgtatcagttggcaattctccgaataaaagaagatatgctccttcttcaaagacaaacctttttcctttacttcctgttactaaatcttttatattataaccacgataagataactcgccatcacatggactctttactccatcacgatattcaaaagcttttatatcagaaatatttgtaagccccgtcaacacaccttggcctttttcatctcgtaagcctctttttacaccatactctgaatacagattcttactaatgctatcattttgttcacaaaaaattgcttgctgtttcatataattttccaaattgctcatttgaatcgctcctttcattctgttacgaacttacatactatactcagatattcttgtttccagagcattcagcattgtctgttctttttcttattcttattcattagcaatacaatacaatggaaaactcaatttaacctcaacaaggtttgttttttcatccatgcaaaatcttctttgtacaacagactgttagatataacaaaaacggcctttcaaaaacagttaacttctaaatcaactgttttttgaaaggtcgtttcatcagattcttatagcaatccagcaaataatctcataaataattgtcccagtcgccgtacgtacggttcaatgggaggggcgagataattattctccctctaccctattttggtgcaaaggaagaggatgcaatttctgatttttacggtatactgtctgtagaaaataaaatgacgtgagagtatacctatgaaaaacaggacaggccataggcttaaatatgttagaatatgcaggtgtaggggagtgaagcatgcagttcgtgttgactaatttgtataacagctgataaaatgattgggaaaattacggcatctgattcattcatctgcagagcatttggtgaaaaagatacgacggtaattgtgttgaacaattttaatataaatgaataaaaactctgacggcaaggatgatccgagcaggaatagttaagaaataaggatttacagaaccatctttctgacagattgcccgaaagatggttttttgcgttgaaaataacaggaggatagcatgttaaaggtagcagtatacggaaagggcggtattggaaaatccacagtgacttccaatcttgcagcagcttttgcaaatatgggaaaacgtgtcattcagatcggatgcgatccgaaagcggattccaccattaatttacttggtggtgagccacttcgtccggtaatgaattatatgagggaagaggacgaggagccggatgagctggcgcagatttcaaaggaaggctatggaggaatcctctgcattgagacgggcggaccgacaccgggacttggctgtgcggggcgtggaattattgcgacttttcagcttcttgaagatatggaactattcgaacattataaacccgatgtggttttgtatgatgtattaggtgatgttgtgtgcggtggatttgcagcaccgattcgtgagggatatgcgaataaggttctgatcgttacatccggtgaaaaaatggcactgtatgctgccaacaatatttccagtgcagtcagaaattttgaggatcgcagttatgcccgggtatttggcatcgtgttaaatcacagaaatgtggaaaatgagaaagaaaaagtacaggcattttcagaaaagatcggggtgccgattgtgggagaagtgccgcgaagtaatgaaattattcactgggaagagcagggaaagactgtgatcgaaggagatccggtctctgaaatcagcagatgtttctttgatcttgccacattgttatggaaagaagaggaaaacgcatgagacaggaagcatatttttgtacggtaaaagagctggatgagcttggaaaaaataacattcccagacagcttatttcccatacacatctgatctacagttcccctgcaacgctggcattcaattctccgggagcagaaggatttggtgtcaaacgtgcaggtctggcagttccggattctgttatgttgatcgtgtctccgggatgctgtggccgcaatacctcggtgcttagttcgatgcgggcctatcaggaccgtttttattatctgttgatggatgagacggatattgtgaccggaaggcacctgaaaaagatccctaaggcagtagcggaaatatgcgaaggacttaagaaaaagccgtctgttgtgatgatatgtattacctgtgtggatgcgctgcttggcacggatatggagcgtgtctgtcacaaggcagaggaatatgcaggggttccggtaaggccatgttatatgtatgcactgaccagagaaggcagaaaaccaccgatggtgcatgtgcggcagtccgtttattcgttgctggaaccgaaaaagaaaaaaggaaacgtggtgaatttactgggatatttttcaccgcttacggatgactgtgagctgtatgatctgcttcatggggcaggagtaaaaacaatccatgagatttccaggtgcaaggattatgcacagtatcagaccatgtcggaagcaaattttaatctggtactgcatccggaagcgcgctttgcggcagaggattttcatgaccggctgaaaattccatatatcgagctgcgcagattatatcagatcgataaaattgccagtcagtatcgtgctcttgccgctgcactgggtgtggaatttgaggatgaaataccgcgtaaggcagcagaggaggcggtagaaaaattccgggaaatacatccggatgcagtatttgccgtaggagaatggatgaacggagatccgttcgaactggcacttgcattggtacactatggatttcgtgtgtcggagatttatggaacattatccggtgaaaactttgtctatgtaaaacaactggcaaaaatcagtccggatacgaaagttttttccaatctggaaccgaccatgctgtattatgacaaaagtcagtccggcgtcaatatgaccataggaaaagatgccggctattatcataaagaatgttccaatgtgctctggaatgaagaacggcagccatacggttatgccggtgtgcgcagactgtttgaagcattggcggaggtataacacaatgagaggactgagaaaatatctgacaccatttacaccggatcagtcaggtgcggtgtctgtattatatgaatttggcggtattatcgtcatttgcgatgccggtggttgtaccggaaatatctgtggatttgatgagccgcggtggtttgagagcaaaagcgcactgtttagtgcagggcttcgcgatatggatgcaattctcggccgtgatgacaggctggtggcaaagcttgcagatgccgtgacaaaactggatgcaaagtttgcagcgattatcgggacgccggttccggccgttatcggaacggattaccatgccttaaagcgtatgacggagaaaaaagtggatctgccgattctgactgtggatacggatggaatggaattgtatgacaagggggaagaaaaagcctggaaggaactgtttttggtatttgcaggtgaaaaagaagacgtgattttgggcagaatcgggatacttggcatgacaccacaggatatcagtgatctgcgtgcagcagaccgtatccgggggcgttttgcggcagaaggaaaaactgctgtctgctttggaatgggaaatggacttgatgatgtaaaatcggtttccaatgtggaaaaaaatatcgtggtatcgccggccgctttagaggcagcgaaatatctggaacgaacatatggaacaccgtacgagacaggctatccgctggtggatgaactggtttacgatatggattatcatgggaaaaaggtacttattgtacagcagcaggtgatcggatctgcaatccgggaagaaatacaaaaaaaagcaaaggatgcacaggtgacagttgcaagttggtttatgataaagccagagctttgcagtgatacagatctgcatctgcgggatgaagaagattatataaggctggtggaaaacatggaatatgatgtgatttacgctgatccatgtatgaagcgtatgacaccggaatttgacggaatctttgtggatacgatacattttgcggtgtcggggcatcttgcagagatgagataacagttgccggtggtcttgtaagatgtgacccgcaataagggcgtgtacgattggagaaaagtgtgtataagaatgagatgacctggcgcatccgggtatacggtatcgttcagggtgttggtttccggccaacggtaagccgccatgcgacaaaccatggaatttacggaactgtttgcaataaaggaccctatgtggaaatttatgcacaggggacaaaagaacagatcgatggatttttaaacagtctgaaagaacatccaccgaagcgtgcggctgttttgaagataaatacagagaatatcaccgcagatacaacagaacagtttgaacattttgacattatcgaaagtgaaaaaacaaaaggggaaatctttatttccccggatattgcaatctgcgatgagtgcaaggaagaaatgtttgacccgaaagacagacggtatctgcatccgtttatcaactgcacctgctgtggaccaaggcttacgattctggatgctctgccgtatgacagggaacgcacaagtatgaaagagtttccgatgtgcccggactgtgcaaaagaatacacggatgagaaaaccaggcggtatgacgcgcagccggtgtgctgcaaccaatgtggaccacaggtgtacctgatcggcagacccgagcggggacgtgccgcaattacatatacacgccggcttattcgtgaaggcaaaattgtagcaatcaagggaatcggagggtttcatctgtgctgtgatgctacaaatgaagaagtggtctgccgtcttagaacattaaaaaatcgcccggccaagccctttgcagttatggcaaaagatgaatcggttgtaaaacgggaatgtgtggtgacgccggagcaggaggcgattcttaccggacatcagaaaccgattctgttactggacagacgaagcgatggcgggctggcatcttcggtggcaccgaacaatccaaaagttggtgtgatgcttccatatgcaccggtgcagttattgatttttcagtatgatgatggtatcgagatgccggatcttctggtgatgaccagtggaaatacttccggtgcaccgatctgtcgtgaggatgaggaagctgttgccgaattatcccatttgtgtgatgcgatgctgtcacataaccgcaaaatcaggatacgggcagatgatacggtgatggatttttacagaaatgaaccgtacatgatccggcgttccagaggctatgcaccgctgccgtttatgacaaaagcagactggaaaggacaggtgctcgcggttggcggggaattgaaaaataccttttgcataggtgtggacaacaggttttatccgtcaccatatgtgggagatctggaggacttaagaacggtaaaggcattgcaggagacaatacaccggtttcagacattgctggaagtaaagccacaggctgtggtctgtgatctgcacccaaaatacaattctacggttgtagcggaagaacttggatatccggtgataagagtgcagcatcattatgcacacatattatcgtgtatgacagaaaatgactgtcatgatccggtcatcggagtcgcttttgacggaaccggatatggaacggacggcacgatctggggcggagagatcctgctggcggattatgggaattttacaagattcggaagtattaccccgtttttacagatggggggcgatgcttctgcaaaagagggctggcgtattgcggtctctatgatttacggatatacgaaagatcgcaaaagggcatgggagatcatggaaacactgggtctttgcagcgaacaggaaagcagggtacagttcaccatggcagaccggaagattaatgcggtggcttcaaccagtgcaggacggctttttgatgccgtcagtgcgatactcgggatcaggcgcaggtcaggatttgaaggggaagcatcgacggcattgcagtttgcagcagaggcatacgagcagcagaacctctcaaatatctcacaggagcaaaaggaaaataaggatatactgctgcatgaaacaaaagagcgtttcgttttaaatacacagatgttggtgcagcagattacagaagcaaaaatgcggggcgaagacaccgggatgctggcatatcggtttcatcaggtactggcagaaatgattacagctgcctgtatcaaagcaaaagaaagcagtggcagggataaagttgccttaagcggtggcgtattccaaaaccggttactgctgcgtctgacagaagaacgactgttacaggaaggattcgaagtgctgcggcaccgtatgattccgccgaatgacggaggaattgcaatcggacaggcagcatatgggatgtatcaattacagaaataggaggataaaaagatgtgtgtaggtttatcagctaaggtagtaaaaatcagtaatggcacggcggtcattgatgcaggtggtgccaaaagagaggtttcttcccagcttctggaagatctggagccgggagattatgttatggtgcatgcaggtgtagcaattgcaaaaatcaccgatgaggacgacagtgaaactgagcagctcatggaggaatttttataatgaaaacagccagagagatcattgaaaattatgatggcccggatgtgcggatcatggaagtgtgcggtacgcacacacatgagattttccggctgggaatccgtaaactgctgccaaaacaggtagaattgatttccggaccgggatgtccggtatgtgtaacaccggttagttttatagatgaagctatttatctggcattggaaaaaggagttacaatctgtacatttggtgatctggtgcgagtgccgggaaccaatatgagccttgcgggagccagagaacagggagcgaaaatccatgttgtgtattctccggcagatgccgaaaaatatgctggagaacatccggatgagcaggtgacatttctgtcggtcggatttgagacaacgacaccggcaggatgtctttccgtaaaggcggcaagagaagatggactggataattactctatattggtggcaaacaaaaccatgcctcaggcgtatgaggcattaaaggacagtgcagatgtatttttatatccgggacatgtcaatgccattacgggaacacgtctttgcgaagctctgaccgaagaaggggtcagcggtgttgtggcaggatttacggcaaaagaactgatgacagcactggcggttgcgctggtaaaattccaggaaggaaagccattttttgtaaactgctatccgcgagtggtgacacaggatggaagcagggaggcacagctgcttgtagatgagatgatggaagcctgtgactgcgaatggagagggctgggtgttattcaaaaatccggcatgaaattaagacaggagtggcaggagttcgatgcacgtctcaaatatcagatgccgaaaattgaaggaaaaccaaatccggcctgccgctgtggcgatgtacttcaggggaaatgcaaaccatccgattgtaaagtatttggaaaaggctgtacaccgcagcatccgatcggcgcctgcatggtgtccggtgagggagcctgctctgcatattatcagtattcataagaaagaaggaaaaaacatcatggaaaataaaacagtaacgatggcacatggtgccggtggaaagcagacatccgaattgattgatcaggtgtttaaggcacattttgtaaacaatgatctgacggcagatgatgcagcggtattagttccgccggcaggaagaatggcagtatctacagatgggtttattgtatctccggcattttttccggggggaaatatcggcaaactgtctatctgcggaacggtaaatgatcttgcctgtatgggtgcaaaaccgctttatcttacctgcgcttttgtaattgaagagggatttccaatggaaaaactcgaagaaatcgcagctgccatggaaaaaacagcaaaagaggccggagtacatattgtatcgggagatacaaaggttgccggaaaaggacaggtggatggaatttttatcaccacgaccggaatgggggagatcgaagaaggagtgaccgtcggtggagaactggcaaagcccggagatgcaatcatcgtaaccggtgatatcggacggcacggatgtacgatcctgttagagcgggaagattttggcatcgatgcggatgtgaccagtgactgtgcacctttgtggaagaccgtaaaggcagtcatggataccacacacaacctgcatgtgatacgtgatgcgaccagaggcggcgtcggaacagtcctgtatgagatcgcaggtcagagcagcgtaggcatccgtttaaatgcagaggctgttccggtacggccggaagtaaaaggagtctgcgggatgcttggacttgagcctttatatctggcatgcgaaggaagacttgtcatcatggcaccaaaggaagaggcagagggcattgtagaaacattgataaaatgtccatattccgcagatgcagctattattggtgaagtgatcgcagaggaaccgggaagagttataatggagacggaaatcggcacacaggcactgcttccacagccggggggagagcttttaccaagaatctgttaacaggaggagtcagggtatggaaaccagagtggcagttatttcaattattgtagaacaggaggatgccattgaagaattaaatatccttcttcatgaagcacgtcggtacattgtaggcagaatgggcataccataccgcgcaaaaggaatcagcatcataagcattgtcattgatgcaccacaggacgcgatcagtgcactttccggaaaaatcggacatttaaaaggtgtattcgcaaagactgcatattcgaatgtcattactccggcagaagggggaacacaggattgatcaggatagcagtatatggaaaaggcggaatcggaaaatccactaccgtttcaaatgtagcggctgcattggcagaaatggggcttaaggtgatgcagatcggatgcgatccgaaagcagattctaccatattgctccgtcatggagaggctgtgccggccgtgctcgacttatataatgagaaaaagcaggcgttgcagctggaggatatgatacgcattgggtataacggtgttatctgtgtggaggccggtggaccgacaccgggacttggctgtgccggccgtggtatcatcacggcactggaaaagttaaaagagcttggcgcatatgatgtatacaaaccggatgtggttttatatgatgtactcggagatgtggtatgcggtggattttccatgccgatgcggggcggttatgcggacaaaatatttattattacctccggggaaaacatggcaattcatgcagctgcaaatattgccatggcagtggaaaattttaaaaaccgtggatatgccgggcttggcggactcattttaaatcgcagggatgtcccgcgggaagaggaaaaagtggcagaactggcagacgattttcacacagctgttattggtacactatcacacagcgggcaggtggcactggcagaggagcagaaaaaaacattgatggagtgttatccaacaggtgaaatggcagacgaataccgtgcgcttgccatgcagatgtatcgcatatgcggtggcattctggaagcgaaaagcgataaggtaaggtccggatatatacaggaggaagcgtaatgttacgtcgtgtgggggaaaccgttgattcgaaagatgctgtggtaaaaataaaagatgcctcatttccaacaccatttgtttcggcactggagtataattcgccggtgcatggcaactggaatattgtgcatacgggaatgcaggttccggaatctatccagatctatgtctgtgcggataactgtatgcgtggtgttgtactgactgcggcagaaatgaatgcagcagaccgtttttcttttgttcttgtggaggagcagaatctgctaagcggcaatctggaggatattaccatcgagggtgtgacggatgtgttgaataaacggaaggaccatcctgaggcggttctgctttttaccgtttgtctgcatcattttgtgggaagtaatctgaactatatttacagggaactggagcatcgttttcctgacatctgctttatccgctgttatatggacccgattatgcaaaaacatggactgacaccggaccagaagctgcggaaagcaatgtatgatcctcttttgggctgtgagccggacgctaaaacagtatctgtctttggcagtgattttgttctggatgagaacagtgatattaagcgtctgttaaaacgatatgattataaggtgctggaactgcccggatgtaaaacctggcaggaactgttggatatgagcaggggatgcctgtttatcgactgctatccggctggaaaatacgggatggaggcacaggcaggccgcctgggacgaaaatctctgtatctgcccggcagttttgactatgatgagatcagaaagcagttaaagcagctgaccgatgcactcggactgccggaactgacagaagatgagctggcccgcgagcaggagtcctgtgaggaggctctggcaaaagcaaaaaatctgatcggggatatgccggtcactctggattatctgtatcatccaagaccacttggactggcaaaactgcttctgacacatggcttttgtgtgaaagctgtttatctggacagtatcagtccggaagaaaaagcagattttttctggctgcaggagcatgcaccggaacttgagctgatcgcaacgattcaggtgaagatgcgtgtactgccaagaggtgcaagcggggaagtgctggcaatcggacagaaagcggcctattttggccgaagccgtcactttgtcaatctggtacagggagaaggtctgtatggatttgacggtattcgaagaaccgcagagctgatgatggatgcatatctcaatgaaaaggatacagaaaaacttgttgtacaaaaaggatgggggtgtgagtgctgtctatgagacaatcttatcgaatgataccggtttatacggccgatgtgtcaggggtctgttctgcactgtatgaacttggcggaatgacagttatgcatgatccttccggatgcaactctacttacaatacgcatgatgaaatccgctggtacgatcaggacagtcttatttttatctcgggacttacagaaattgacgcgatcatgggaaatgacagaaaatttattgatgatatcgagtatgcagcccgtgaactgcatcccaaatttatcgcgctggcaggttcgcctattccatttatgaatggtacggattttcctgcaattgcgcgtgtgattgagacagaaaccggaattccggcattttccgtgccgacgaacgggatgaatgattatgtgtatggagcgggcattgcactcgaagaaatcgcaaagcggtttgtcagagaaccggacaggcaggagaatagagatccctcttcgcgcacggtaaatctgttaggtgtgacaccacttgatttcggaccacagaaaaatgcagaaaccttaaaagagaatctgcagaaatacggatggcaggttatgtctgtgtgggcgatgggcgatgatttgaaaacgttgcaaagatcagcggaggcagacgttaatctggttgtttcggcagtaggactccgtgtggcaaagatactctgggagaagtacaaaataccatatgtgatcggaacaccaaacgattggctggcagaagatatttcaaatgcactggagcgtgcagccacacggcaggcagagccggcggttgtatatttgcagaaccgcatgcagcaggaggcagatattacgctggtcggagaacctgtcgctatgggatcattagcagcagggattgaaaaaagatatggtcgtgccgcccgcgtcctgtgtccgttaaaggaatgtgcggatttgctcggtgaaaaagataaaatggtgcttggagaggaagcgatggaagaggcacttaaaagtgcagggatcattgtggcagatcctctgtatcgtccgatctgtccgggggacagtattttttatgaattaccgcatgtggcattttcggggagaatatatttttgagaatactattgtcaggatgcaatttgcaatctgcgatgatgaaaaatctataggcttgatattagaagaaaaaataaagaaattattaccggatgtagtgatagaaacatatttatcgggtgatgaactgattgcaagtggttgtaagccggatatgctctttttggatatccagatgccgggaaagaatgggatggaaacggcaaggattctgcgtcagaaggatgacgaagtggatgttgctgcataaaccagttgacagattcctttcggaagtataatataaagacaaatttcataggatataaaaaacaaagggcgatgttgttcagacactgcccttttttatttgaaaacaggagggatgaggttatggaaaagttaaatgatgtgattacagcaattgacgattttgtctggggaccggtcatgctgattctgcttgtggggaccggaattttccttacgatccgcacgcggtttctgacatggagaaatctcggttatgcactcaaaagtacgttaagcaaagaggcgcggacgaaaagccatggcgagggcgatgtgtctccgttttcggcactgaccacagcacttgccgccacaatcggaacgggcaacattgtgggggttgcgacggcgatggtttccggtggcccgggagctttggtctggatgtggatctctgctgcatttggtctgacgtcgaagttcagtgaatgtatgctggcgatcaaataccgtgagaccaatgccaaaggggagatgagcggcggcccgatgtacacgatgaaaaaggcactgaagaataaaagatttggagcggttcttgcgtggttatttgcactctttgctgtgattgcttcgtttggaatcggcaatatgacacagggaaattcgatttccggtgcattacatacgacatttcatgtgccgacccatctgaccggaattgtgattacggtgcttgccctgctgatcattgtcggcggtatcaaatccatttcaaaggtttcttcggtggtcgttccgttgatggcgattttttatgtgatctgtggagttattgtcattatcggaaatatttcgaatctgccggcaggcattttgatgatttttcagatggcattttcggtaaaagcggtaggcggcggtctgtgcggaacgattgtcgcttccatgatgaatgcaatgcgttatggtgtggcaagaggtgtattttccaacgaagccggtatgggatctgcggcaattacggcagcggctgcaacgacggataacccggtgcgtcagggatatatcaatatgacgggaaccttctgggatacgattgttgtctgtacgattacaggacttgcgattgcctcttccggtgtccttggcatgaccgatgctgccgggaatatgctgaccggttcggatgttacaattgcggcatttgagacggttctgggatcggccgggggctggcttgtgacaatcgggattacattgtttgcgttttctacaatactcggctgggaatatcacggggaaaaagcatttgaatatctgctgggaacgcaccagtttaatatggtataccgccttgttttttcctttgttgtgtatttcggatgtacacagacactgaatctggtatggagtttctcggatattgccaatgcgctgatggcaatcccgaatctgatctgtatgctcctgctcagtggtgaaattgcaaaggatattcgggagtttcagaaagaaattcataaatataattaaaaaagctgacttgaaaaagtaaattccagtgcaggggtaaattccaccacgctttaaaattctttgattttttagaattgtgggaggctaaatccttataaaacttgaagttttaccctcatagagcgatgtttgtgcgtcaacgtgtcgcaccaaagatattctccacttccttggaagcaagaaggtcctttacattctgggtgatgccggtcgggattcctccccattttctgaaacgcttccatatttcaaccgtataggctgccgtctggtcttcacgaagaagaaggtgcatctcatccatatagtatctggtagattttccctggatacggttctccgttactcgtccccatacctgatcctgtaccacgagcattccaatctttttcagctgttttccaagatccttgatgtcataacatacaaggcggttcgtaagctccacattggttctgtggttgaatacattcagggaacctgacacatagatttcaagggcggttgccacatgctttgcctccggttcctcctgggaaagtagtgcctcatacagatctccaaggatcggcatattctccggacccggattttcaaaatatttttgatagatctgcctgatacagcggtcaatgaccgtcttttctaccggacgcagaccatccttattcccgacgatcagctcacataaggacaagataaaatctgctttcagtgcaatcggattgtcgtcatccgaatagttcatattgatgtccatagggttgatgtactggtcggatgtcggactgatcctgataacctgaccaccgaaccttgcaaccagcggagaatactctgactccggatccgagatgataatgtcatcatccgtaaccagaaaactgttggcaatctctctctttgcagaaaatgacttgccggatcccggtgtaccaaggatcagtgcattcggatttttcagtttctttctgtccaccatgatcatattgttggaaagcgcattcagaccataatacaatgcctcatcccctctctggaaaagctcctgagtggtgaatggcacaaaaatagccgtactggatgtggtcattcccctctgaatctcgatcaggttatttgccagtggcagtgtgctcataaggccctgctcctgctggtaatccagcctgatcatattgcagttatgtttctgtgcaatggaagccgcctggaacacattgttttccagctcctgcttcgtccttcctgtattcatgaccagaaacgtcagaagaaacattctttcattctgggactgcaattcttttaatagtgcctttgcatccttgccataagttgcaagatccgatgggatgatatccatgtcatagccggctcttactgcctttttctgttcctctatcttggaacggtcaagctctgtgatcgtatgcttgatggtcttgatcgcctcattctgatctacggactggatatgcatggtaacgatctggcttgattccatggaaaggaaatctgccagaagcctgtcgctgatatccgatgcatcaatggataaaaagctcatgcatccatacatctctccaatctgaaaatatcttccggtaggaaatgcaaagctgctcggtgcaataaaatccttaaccgaaagtcctgatcctgtcaggtacttccagtcgaaacggaacttcgcatcatcccccatatgaaactgtctgtgcatcagttccagcctttcactgccgtttaagctcctcgcctgtactcccagcctcttgaagttattgaggatatccgtttcgatatgcgtaagtctcggctttgctgtcttcatggactccgcatgaatcccgaaagtaagatatttagtcttcgtaagaccattatttcccgcttccatctggtgaaggagcacttccgaatactcatccctgacatcatcgaatccgtcatttttatgggaaatcttgatgctcttctcaaaatccgatacatccgttgccatattctcaaatgaaagctgaaactttacggaactgtcaaagaaatttaagaatgcgcaccattcctcaaagatctccgtcttgtcttcctgctgtgccagctggtaattgatatcctgaaactggactgtctttgtataataatcaagccctacacggcagataccatccggaaacatcctgtcaaaaggaatgctctgctgtgccgtcttcggtatgccatcatttttccgggcgttttttacgatctgccttactgccatctggtctgccctgcttaatccttccggcattgtgaacttcctgctctcctgatttttctttttgagaaagtctaacaatcttttctacctccttttctgcctctgcctgacgcagaagtgctgcgtaatagttatccgtcttatatgggcggatcttcggccttttgaaaattgcctgtatcatatggttcaaaatgacttccagcggctgtccgtttttctcatacatggcaaggaaaaagaatggcatcataatgaccatcattcccatgactgctgtattagtcttcattactgtcttcatcagaaaaaatgacggtactccgatcagtaccgccatgccaaaacagatcagctgcctttttgtcagattgaacatcaccttgctttttacttttgtcaggtcccttggaacactgatataagatgctgccatactctgcctccttaatgtgcatggaatatactgtgtgctactgctccggtcttaaataaggtaaatgccagcaggatcgtaaagcccataaccttccataacgaagcaatgatatctgtgctgaatgctactgactggatcaggactgcatagattcccacacataccatgatcaaaaatccctgaaatcccagtgcaaacagacttctcatatagttctggcccatcatgctctgttccctgtttccaaaggttgcaaatgggagcggtgccagactgaccatcagatagatctccaccatacgtccgttgataatcacaaagatgactgccgaaagtacgtacatgagaaactgcacgataaatgactgtaggaatattgcaaaaagcggtcccagctccatagcctccagtgtggactgcatggttgccagcgtactggcatctactgccgtgcttccctgtataatgcctcctgcctgccgcaccacactctgcgacacatcaaataccgccattgtgatatcaaatgtgtgtgtgatcagttccactgccacgaaagtcttaaagatccatttccagatgaaccatgtctcaaaacttgccagattgttataactgatgatcagctgtatcagctcataacacgcaatgaatgtgagcagtattccggcaaccggcatgatcacggattccgacaggttcctgaccatattaaagactgccggcatgaaattactcggtgtctttcctacttccgttgcgatctgtcccacctggtcattcacagaggaaaacgtattggtgaggttgtccatgattcccgatacaagaatgcccttcagccagtcagtaatctgctgaattatgctgttcaattatttcctcctttcctcctggacagggattttccctgccccatgatccaaacctgatttagaataagccggaaagtaatggtacaagtgtagttccaataagggctacaccaccgcctgccataagctgcttcattccctgtgactttgcttatgtgtgataaagaagtaatagaagtgtaaaaaattttgccgttcctatccggcacttgcgcagggtgtcggataggtcgggcttattcttcgggcaagtcaatcttgccgacaaagctataataaatatcaatgcgctggtggcgtacttcgttctcgtcatactcacattcatagacaacgattttctccaccatttcacgcaagagggtgtgtgtcagttcctcgatagaaaggtacttgcggacaacgttcataaacttttcagcgtttaccgtggcttcctgtgccttgtccagttcgccctgcaatgcggcggctttctccttcagttcccgctgctcggcttcgtagtctgcggacatttccataaaacgctcgtcattgattttcccgtttacattgtcctcatacagacgtttgatatagcgggaaagttctgcaatgcggctctgcacctgttcaagctgcttcgtggctgccgcctgtttccgcttgccgcccatttcattctgctggataagcagcttcacgaaccgggcttcatgcttctgtgcataggcggtcactttccgcagattgtccagcacacccgccgtcaaaaggtcggttcggatgaagtgcgccgtacagtcggcggtgcgcttcttatagctgccgcagatgtagcaatcctgctttctcttgtcggtctgataccgctgctggtacatcacatgaccgcagtcggcgcagaacagcaagccggagaacaagcccacatcatcgtagcggttggggcgtttgcgctgcttgcgtaactcctgcacccgttcccatgtctgcaagtcgatgattggctcatggtggttctcgaaaatcgcctgtttctcaatggggttgtctatgctgtgcttcatcttgtaggacggtttttccgtcttgaagttcacaagacagcctgtgtattcccggttttccaacagatgaacaacggtattggtcgcccacttacattcatagccggggtggtagcggcgtatgctgcctgtgcgctggtattccagcgttcccggcgtggggatttcctgctcggtcagcatacgggctatcttggtcggaccgttcccggcaaggcaaagctggtaaatctgcttgactaccggggcggcttcctcgtcaatgatgaaattttcgtcctcgtccatgaggtagccgtacacgggcttgctggtaacaggcttaccgctcatgccttttgctttcttaactgccttgatttttttgctcgtatctctcaccatccattcgttgaaaagattacgcagcggggtaaaatcgttgtcgcccattgcgctgtccactccgtcattgatagcgataaagcggacgcctttctgcgggaaaagcatttctgtatacattcccacttgaagataatttcgccctaaacgggacatatccttgacgatgactgtgccgactttcccggcttcaatgtctgcaagcatggcttgaaatccgggtctttggaagttcgcaccactataaccgtcatctgtgtaccagcagagattggtaaagccgttctgcttggcgtaggtttccaaaatgcgcttttggttggatatagagttgctttccccttgcagttcatcttcatgggataatctcggataaagggcggtaataaggttttgggttgtctgtcttaacatggtttcctccgtttccgacagccagccccactattccgtacttcgattgtaccatacagcggggcggcttgtatagcggcaaagtgtaaaagtgcttctttaccgcccgtcaaaatgacgtttttttgtgttagggttatcacgcagattcaacttcataaatattttacttttatttgatagtccatttcattctgctgtgttataatggcaaaaattgaattagcgaggtaaaaggcttatgaaaaaatatatttctttgtttttatgtctgacttgcattttaactttagttgcgtgtgggaaaaaagctgctcccattcagttgccccaaacaagcgacattacatctgttgatgtaactgttggggaaaacaccacaaatcattcagacacagcttggataagtgaaataatttctgacatttccagttctgaaccaaccagtaagcaaagtgttcaagattttccgcagactgaaagttatatcaagattgattttcagtttgaaacaggaacaagtaccatttttgcctatgaggaaaacggaaaacactatatcgaacagccttatcagggaatttataaaattgacagtcagctgtacgaacggctgcaagaaacaaactaaaatttaacttatccattcagcggtcatgtttccgggcatgaccgcttttccatgccctcattttgtagcagcttccgcttccagcaccttagccattttgtcggcggcggtttcctttgcgccctgcttgaaaaagccggacacgacaagaacagagttccctatacggatttccgtcacgcaatcggcgggtgcggtgcttttcatgctgtgtctgatatgctcttttttatcggtcataggcgaactcctttcaatcgttcatcagttgctttaagcggttcagcttgttttgtgcgctctccctgcggaagttctcgccggagaagcagacaggggcgcacatttcaagcagtcggtcataaatccgggcgtggggcgtgtcctgcgggttctgcaactcggtaagcgtgaggttggtcgtgacgatcagcggcttgccgcttcggtatcggctgtcaatcacattgtagacctgctctaagccatactctgtgccacgctccattccaaaatcatcaaggataagcagcggatagcggcagaggttggaaatatattcgttcttgccctcaaaagtggctgcaaggtcattaagaataagggcaaagttcgtcatgcggacggagatttctttctccatgagggcgtttgcgatacatccggcaaggtagcttttgcctgtgccgacgctgccccaaagcagatagccgatgttcccggctttcatgtcctcccaatgttccacatagaaatgggcggttttcatctgcgggtttctgccgttgtcattggcaaaagtccattcccgcatagccgggtcggtaaagccccggcgtttcagttcttccaccttgtcccggtgctttcgctgctgttcggcggcttcacgctccatgcgctgcgcccgctggcagtcacattcagccggatgtcggtcacgcccaaacagggtagccttatcagccgggaaataggcttctttcggtgtccggcacttgccgcagtagagcagaccgtcctcacctgtgtagtcctccggctcggcggtgactgctggtatctgtaaattcatatcttcaaaagctggtttcatagactttctccctccttgtagctgtaatcgggtatgccccttttcggggcagctttagcggtatcgtcagccacccatctgcggatagtggctgcatggttcttgtatttcctcccagtggaagcgatatagccggatagccggtcaatgtaatactcccacttgtcgggcagttctgcttgcagttcggaaagctccgtatctgtcaaaatcacatttttgtatctgccgtaagcagcgggagcggctcgtcctggttctgactctctctctttttctatctctatatctatctctttctttatctctatctctggtggacaaatgtccgcttttgcttcggacacttgtccactaagccgtttttgctctgaaatcttcattcttgccctgcgcttgcgctccccctcggtagaggactgaccgatgaaaagctcgatattgctcatatacaaagccccgttgtccagcggttcgacaagccccagcttcataaagatttgcaaagcccgttcaactgtgccgacctgctggcgggtaatggtggctatcatttgggcggtgtaggggatattctcgtcaagctgcaaagtgccgccgtatttcagcgattttaagtacagcttcaagaggatattggaatacagcataccgtcctgcatactttccagcagcacgatagcgtcatcgtcaaaatagctttctttcagtttgaggtaataatatttgcggttatctgacataatcttggttctccttatctgcggggcgggctttccatctctttgagtaataccgggggcagagtaccacgatagccctaaaactctgcttgcagtcatgggtacagccccggcaaagggcattgaaagtaatgcggtttcgctcattgaggaagaacgcccattccagccgccgcttcttgctcattctcggcatgaaaaaacgctcctttcttcggtttggtcgggtatgaggggacaggggcaaaatctgtatgttcccggtgtcattttcgggaaaaatctgccctgtaagccccgtttgcaagggtgggtgtgttgcgggtagggtaagctatacccccagccttttgtatggtttcggtatcatttcgggtcggtttttaacgctcctgttcgtgctttttctgacggctcggtgtgccgtgtagtatctgctcggtgttccgcttggcggtggcaagctgctcatgctcggctttggcggtgcggtaggtgttgtaagctgcgtttttctcggaaatgagggcttcaatctccgtattcagcttggaaatggcaggcagcttctttcccggtgcaagcacctttagctggcgcagggtggcttcatagatgatgaaatctgcttcatttgcccggtagtaggtttctgtctttttgcctttcagcttcttgtgttcctcaatagtcgggcgggttcggcggtaatcgctgacaacctttcgcagatttttcttgtcggctatggtctgctcaatgccccgcagactttcccttgcttcggaaagggctttccggctgctctccacggctgcgtccagcttgtcaaggtcaagcaatccgttctccatgagaaagttgtgggtagccgccatctgtttgagattgtgcagggaagcccagcggtcatagcctacgcccttgccctcggctcgtttcgtttcccggtcaaccatgcgctgtaaaccgtcctgtttcggggcgattttggcggatttttccctctgcaaatgccccgtcatgctaccggggtattcgggtatgggtgtggtctgttcggcggctctgtgggcgttctgctccaaaagggcaaggacggcggtacggtcaaaatcatcccccagcttccgggcggtaatgggcttggttctgtccggcgtgagataggacagccgcccccggctctccttgacggagattcccgactgcaaaagcaaagctgaaaattcgtcaaaggtgcttgcccggtcaagggtgttgcgtatggtctgccgcagcttcgccttgtcggtttcaaacttggtttgccggggcgtgataccgtccgctatcatcggggcattggctttatcaagggcaagctgccctttcttctgcgcccagtattcacgctcggtcactcggttcttactgccatgcaagaggtcaatctgatacagattttcccggtggcacatctccatgacttcggacttgaaatattccatagctgcgtctgtgcagcggtgcttcatgccgcatttcgtgtccgctggtctgtccatgtagggcagaagcgggacagcttcaatccgcaagctgtttatgacgatatgcacatgaatgttgccagagtgattgtgtccgtccgggtgggtgcagacaatggcttggtgtccggggaaatgctctttgcaaaattcctcgcccagcgattgtgccttatcaacggtcaagccgttgtccgttccgtcccgtgggtcgaagctgatgatatagtggtgggacttcacatcttcccgtttttggtttttgccatagcggagattggagcgcatacaggctacggcaaaatcttcatcgccgcagttcagcgtggcaaggcggtagtcctcacgggggacaagccgcccgttttcatcaagggtaggcttcatggtaaactcgtcatgctcaaaggtaaggtactgctcggctgccccgtagtcggcatttttagagctgatatgtttgaatgttgccaacggcttcacctactttctgcaagacttcaaacttcaaggctgcaaggtcggaaatggcgactctgacttcgccggacagggcgttgtacggcacaccgtattcgttcagataccgggcaatctgattgaggttgccgccgatcctgccgtattcggcggtcagcttcccgacagcggcaagcaattcatcattgaccggggaaacggtaacaatggggcgtatggttgcccgtgtaatggcttgccggataaattcggactggctcataccataaggggcaagccgggcggtaaaatcggcgtattcttcatcggtcagccgggtcttgactaccctgctgcggtggggcgtgttatatcgtttcataggtggttgacctcctttctgtgcgtggtgtcctctcactaataggagaaaaacggggtgtgtagcggaactgtttttgaaataatccgaaaagaatttgcgggaatttttcaagcggctttagccgccatagcagggtttggggaaggcactccccaacaagattcccgcaaggacaaaatgagcgataagcgaaatttggtactgcggtagaatcttgctctaaaaaactgccgctttcctcggcggctctggtttgcggatatactggcttgctccaccaatatagcgattgcggcggcgtgttctgcccgctgttcaccactacaacggtgaaaaaggtgcgttttggcaaatgcagcggaaatttttttgatttccccgtcctgctccctacaacaatccggcggtgtggtttgccaaagatttttgaaaataggcgcaaaaaaagcagcaaacctttttcaagatttactgcttatatgccgctgtgatgggcggcggtattaaattgtcagccgtttttcaaatggaatttatctgcaatcgctttcttttcgctttccaatcccttttctgtaatcttccataatcctaacgcaatgatctgctatcttttgcattccgagttcttcaaaaaaagcaatttgtattttcatcagttcttcgcaaacagccaacttctgctcatccatattgctaatagcaagccatgggaacgctttatatttcttagtgtcaccaatgagaaaattgtaccctatcaactcattttcacggaaaacgaaatagaattgtggacctgaacccggaactgacttttccataatttgttgcatggttttcacaccgccgtatgcaggaaaaaaacctattcgctcaagagcatttaatatgtcaagccttttatctgtgggtatgtctctataattgataatctgttccatttgctccacccccattaaagtttaatttgtcaggctctaattatacaacttttctgcttagcggtcaaagcggaacttcaacaggctttctatcagccgcccgacgatatgttcctgcatatctgtgttgatctgtccgtccattttcgcacaagagcggatatatccggcataatgggataggacggcggcaacagcttccgggtcgccctcgcttgccttaacgattgtttcataggaaagtagctggctcataggacaagccctccaactctgcccgtagccgccgcaaaatcatctgaatacgccgcccggttgtgttgcctgcccgtccatatctccgtccaatctccctatgcgtcaatcgttggaagtagtataggaaaatgatttcctgttccatctgtgatagtgcggacagggctgcggcaagctctggactttccaaaagcaccatctgaccgcagacgaaaagcggatagctgttcatgccggattgctctgtaaagtatttatctgtggtgctgaatggatagtgtttttcttctatcagatattcaagcgagatttcccgcttgcggcggctgcgtatgcttcgggctgcgtctatggcagcgtggcgaataacagtcttgcaaaaggcatcgtgtgtatgccgaatatgttcttgatacttttcgtgttcggtcatggaaaatccccctttctgaataatggcagagggcggcagcattttatgctgtcgccctcttggttaccgaacagcaaagacgggcggggctgtcaacggcggcgcatttgcgccgttcatcttgactgttgacaggctcggctgggtttgctatctgctcacggcaattcactctcattgataggaattgcttcaagttccgtattcaaattgttccaataagagccaatatccgcacttgtgaaatacttaaaaccgcctgcttctgacttcaattcgccgtttttaactccatagcaggcgtaaatcaaatcgtagcttgttccatctgagaggttaaatctaaagctggtcacatctgctccagcagtttcctcagttgttttgtcttttagggataagcccttgaacttatcatacagggtctttatatcattttcagcaacaactactttcttttctgctgatgcaggcactccgtcatagtggtacatttcaacgctttcgacatcttcaacctcaaatgggaagtcgattttgacaggctcataagcaatgtttataggtaacagaaagagagctgtaaaaattgcaatgatacaaagagtgatggaaacgagaacagcaatcgttatcttttttctgcccctctgcttttcttttgcctcatggcgcataataacgctttcgctttcttcgtgaagaacatcttcgctcttgtgagaaagcaatttctgataaattgcgttacagtcagcacaggcgttcaaatgctcttttaccatctctgcgcttgcttcgctgcaagcaccgtcaacatacagcggaagaatatctcgaacaatatcgcattgtttactcatgcttttcatccatcctttcttgaatttttagctttgcacgatgataagtaactctcgcccatgattctgtttttccaaaaattgcagcgatttgtgaaaaagatagttccccgaatacgcgaagctgaaagacttctttgtatggttcttccaaacggtgaagaacgaggtgtatgcggaacgccatgtcagaatctgtaactgagttctcaacattttcatttgatggcaagtcattgatttcactcacatcagctactcgctgacggcttcgcatttcatcatggtaaagattttttgctatggagcagagccatgtcaattcatctgacttacctttgaattgtgatgttgtagaaacagccttatagaatgtgttctgcgtgatttcctctgctatctcacgatttttagcaagagaaatagtatacgagtatacctgtaaatagtaggctttatagagcttttcatagtccatacttgtcatcacctccttcagcttcataggttagacggagaaatcggaatttcgttacaaagaagtttgaaatttttatacctttacgctactcttgctttctgcggactattggtagacgcgcattaacggcaagcaaagagattgctgtgtcagcttgatatgttcaaatgctaattaagtatagcatacagctatgaatttttctattgcgttcccctgacttcggaatagtggcagggctggctatccatgtcttgtgcttctctaccgtacatgagcattcgcaccggggttgtcatttccgtagccttccataagattgattgctccccagattccaagtccggctccaagggcgatcaccagagtctgtaaagttcctactgcgcttgtaaaaaatgccataatataaatcctcgtataataagtgtatagccagtagaaatgatggttatgcacttatccttgtgaaagtcaaggtaggcgtgaaattccttgataatcagacaaaggcgacgcagatatcgcagtatgaacttgtgctacataaggatagtaactggaagattgtaggataaattatatagcgtgcatttcctaaatgagatttgcacgcttcactttctgtacaaacaccatataacacttgacaacagcgttactctgttatatactgtttatacagaaaggagctgtgagatgaaaattattataaaccattcttcaatgatacctatttacgagcaaatagtagaacaagttaaagctttaattcggaatggaaaattaaaagaaaatgataatcttccgtctgttcgttctcttgcaaaagaattaaaaataagtgctctaactgtgaaaaaagcatatgatagcttggaaaacgaggggtttacggtaacaattcatggaaaaggaacatatgttactgctacaaatacagagcttttattagaggaacagaaaaaggaattagaaagtgatttagaacgagttattcaaaaaggcagatgttacggtatcagtgatgaagatataaaaaaactatttgagttaattttggagggttagatatgttaaaaattgagcatttgaaaaaaagttatgaaaacttttcgcttgattgttctcttgaagtaaagaaaggtcatgtaactggtttgattggtcaaaatggtgcaggaaaaagcacaacatttaaagctattttagggctaatttcctttgatagtggaactatcaatattcttggaaagtcattacaagattttactgcaaaagacaagcaagatttgggagtagttctttcggactctggctttagtggatatttaacaatcaatgatattattcctattattgataatttatatcaaaattttgataaatcattttttatagaacaagttaaaaagtttcagcttccacgaaataaaagaataaaagatttttcaactggtatgaaagcgaaagtaaaagtcttagttgctgtttcacacaatgcaaagttgttaattcttgatgaaccaacggcgggattagatgtaatagctagagatgaattgttagaaatgctaagagattttatagaaaaagacgaagaacgctctattttaattagttctcacatttccagtgatttagaaactttatgtgatgacctttatatgatacatcaaggaaaagtaattatgcacgaagatactgatgttttactaagcgattatgcactacttaaagttgatgaagaagaatattccaaattagatagacaatatattttacgtacaaaaaaagaaagctatggatatagttgtttaactaatcaaaaacaatattatgctgaaaattatcctcaaatggcgattgaaaaaggaaatatagacgaagtaataacaatgatgattagaggtgttgaataatgaaaggtttattgattaaagattttaaattgctgaaaggacagaaaaacttctttatgactattactgctatatctataataatgataatagtatctccggggacttcgtttccgattggtttcttaggttttgtgggggcattattctcattgagttcaattagctatgatgaatttgataatggaaatgcttttttattttctttaccgataacacgaaaagattatgtactggaaaaatatatttttggattgatttcaggaataatgtttttgttgttgggaactgttattagtttagttgttattggtattacaaaaacaggcagttttaatgaaatttttttaacagcaggttctttatttcctactattttattgattttatcaatcatgcttccttttatcttgaaatttggtggagaaaaaggaagaattgctatcataggtgtaatgggatttatatttgttataggactgcttcttataaaaactactgaatatttaggaatagatttatatgtcttaataaataaattacctaaatttgaaccactagtatatataatattatttttattgctttcagttgttattttaggtatctcctatcttattagcttaacaatactaaagaaaaaagagttttagaaaagagaggtgtgcttatggacttgactattttggtagtaggattgatattgggcgttggtattcctttaagaaataaggcaatcaaaaagcgtagagaaaatatgaaagagaaaggaaatgaggaaaaatgaaaaaatatgaatatttagaaattgattatactgcgaaaggtgttgtgttcctttgcaccgataaacataaggaagttataaatagctatgcagaaaatgggtatcgctatgttggttttatacctacagaaattgacgcaaaaggttgtatgcgaaagattgatttaatttttgaaaaagaagattaactcattttagggagttggttcgaatgatagggttaaaaaaacgagatattaaaaaagcattaaaggctggtgcaaaggctggcggtatgtcattagctgatgtacgggaaaatattgaagcaacgattgatgaagctatgaatagcaccgacccagaggtgcaggcaaatttcaaaaagtattttgggaataaacgccctacaccagaagaatatatttatatcattacaaaaaagacaaaggtaaaattataataaaagggtcgtggaaatgcttcacaaaattgtgatctgcattatcacggctcttttactctctgtttactttcaaaactgtaagtgtacaaatatattgcttgtgattgaagataatggttgtggaataaaagcgtctgatttatcccgtgtatttgaaaaaggttttacgggttcaaatagaaacaaggcaaatgcaacgggtatgggactgtatctatcgaaaaaattatgcgataggttgggcttgaaattggatattgcttctacggaaaaagaatatacaagactgaccattacatttccaaaaggaacagttcataatttttcagagtaatttgaaaaccatgccaacattgatacggtgctttaagggggcttgcattatggaaagctttaagtacaattctttgcaatcaaattccacctaatagcacactattaaaaattgaatatgttttagctttaaaggctcgtacagactatatgttttgtgcgggcttttttcatacccgaaaaaaatttaaaaatttttcaaaagaggtcattaaatcacacctttcattccctatatggtgcggaaagagggataaacacttttcaaatcatagtggaaagggggtgagattgatgaaaccgtctgacttccagaaaacagttcaatgtcgctttgaaagttgtttgaagaaagttgtccgtcatattgtaaaggactaccaacaaggattgaaacgacgaaaagataaagaaattccattctgtgaacttccagaaattttcgttgaaaattttgctgtgtgggatgactacgaaacagattatacaatcttttcagtatgtggcattgatattcgtgtccttgatgatgagctggcagaagccttgaaaaaacttccagaaagaaagagaaatactttgttaatgtattacttcttggaaatgacagaaagtgaaattgccaacttacaaaagattacgcaaagcggtgtatttagaaaccgacatcatgctttggaaactatgaaaaaaatactaaaggagaagcagtaaaatgaagcaaacatttaagaagccgtcctactatttgctttcgcaagcaatggacggggacgaaaaagcgattgaaaaaatactggcattttatgacccgtacatatcaaagtgctgtttgcgtccactctatgatgaatacggcaatgtctatattgttgtagatatggagttaaaggaacttatccgagaagcacttatcaaaatgattttagggtttgatattgccttagaaatcgaagaagaataagcagtttttagcagagcatggtttaatgtccccctctttcctgctctgccctgcttttacatgaaagcaacacgctttcgccacagctctttgacaactgaataaagcagacagatacgtttgtgagatagcgagccacggggactgtacgccacgacctttccaaaagaaagcgagcgacccacgcagtgatccgagagcgactgttggaaaagtcgttttgccatgacctatcctcacagaataatgatacgtccgcatggtgcggttctgcccacaagaatgggaatagttgagatactaatggagctttccaaagccgtctgtctgcttgtaaaaaaacaacacacagtaaagggggtgcatagattatgaacaatactgatgtgcctatctgggaaaaatatacgctgacgattgaagaagcgtctaaatacttccgcattggcgaaaaaaaattgcgtaaattagccgaagaaaatattgacgctggctgggttatcgtgaacggtaatcgtattcagattaagcgaaaacaatttgaaaaaatcatagatacattggacgaaatctaatgtcattgagccgtagatatggtataataaagtatagcgtatcacggctcattccatgacggaaaggagctttacactatgtctaatgtaaaacgaaaagacagtaaaaatcgcaatttgcgtaatggagagagccagcgaaaagacggaagatacgtttataaatataccgatatatacggaaagccacaatttatctattcttggaaacttgtaccgacagacaagacacctgctggaaagcgtgatgatatttcattgagggaaaaagaagcacagataaaaaaagaccttaacgacagtatcgacacagtcggcggtaaaatgacagtctgccagctttacgagaaaaagaacagccaaagaaagaacatcaagagggctaccgaaaagggacgacagtatcttatgaacgctctgaaaaatgacccattgggtatgagggcgattgatactgttaagcagtcggacgctaaagaatgggctatcagaatgagtgaaaaaggatatgcctataaaacaattgataactataagcgttccttgaaagcgtcattttacatggcgatacaagacgactgtatcagaaagaacccatttgaatttaagctaagtgatgttctggaagatgatacggagcagaaagttatccttacaccagagcaggaagaacgcctgcttgcctttatggaaaaggataagatttacagcaagtattatgatgaggttgtgcttctgttggaaacgggacttcgtatttctgaattttgcggactgacgacgcatattgatatgcagaacaaaatactcaatatagaccaccagttattgaaagacagcgaaatcggctactatattgaaacgccaaaaaccaaaaacggaaaacgggaacttccattgacagaacgggcttatcaagcaatccaaagaatactaaagaacagaggaaaggcacaaccgctgattgtaggtggttacagcaatttcctattcttaaaccgtgagggcttgcctaaggttgcaggaaactatgagggtatggtgcgagggctgattaagaagtataacaaatatcacacggacaagttaccgaacatcacaccacattcattccgacatacttattgtacaaatatggcaaacagaggaatgaacccaaacaccctgcaatatctcatgggacacgccaacataaccatgacacttggctattacgcacacggtacatttcaatctgcaaaagcagaactggaaagactggcttgttaatatcggagcgtatatttactactcatttactacttttggttgcattttcatgctggtaaatgccagcttatgcaaggtatcttccgaaaagaaaataccgataaagccctaaaatacgggatatatcggcatttaccaacttatgaaaagataatcagaaatttagtaagtttttaatgtacacacaagtaacaaaaaagtgtttttacctatataaaaagaaaaataaaatcgacatgccggaatgattgaaaaaaaacgaaatttggggtatgattataggcaatgaaacgttaaggagaaaataatcttgaatacgaatggaaacaaaaacacgttaaaagcaaataagatattgattcctgttatcttgttgatcggattgattccaatcattgtgcattcttttgtttatgacacaaatctggcacagtttgactggtatccggagagcgccgcaaagcagacggacttcttttttgcatggaagatgattgcgatcatccttgtgggagttgtaatgctcgcaattttattgatccggtatttgaataaaaaggagtttgcatttgaaaattccttttattttctgatggtgtatgcattgtttgttgcaatgtctgccctgttttccagtcacaaatactgggtggcacatggtacatatgaactttttgagcctgtatgggttatatttgtctatatgatactgtgttattatgtctataattatgtacaggaagaaaaacagatagaggtaatcctgcgctggtctggcattggaatcgcaattgttactctgattggatttttccaggtctttggattggattattttaagacatctctgggcaaacatctgatgacggacacaagctggtggaaccaattagataagatttcctttaatttcgcagataagactgcgtatacgacactttacaatcctaactttttgtcattttattttggcatgctgataccattgctggtctgcctgtttattggggcgaaaaagatgtggcatcgtcttgtaatcgcggttgcagagattttttgcattgtagcactggttggtagcagaagttcttccggatttattgcactggcaattggtgctgtgattctcgcattggttttactcagtcggaagaaaaaattatttgtagccgggattgttgtggttattattggaatgatagcagcaggagtactggcaaatacgacagagttcggtcaaaatcttaaaaagacggttgttggaacgtatcatatgaaagatcagttctctttaaacgatatcaaaacaaacacagatgatgtggaacttgatatctggaacaatcttctgcatgtgtcctatgatctggggagcgacggtgtaatcaccgtggtctgcaaagatgcagatggtcaggagattcagacaacagaggtagatcaggaaaatcatattttggccctcaatgatgaacggtttgcaaatatacagattcagccgatcatgtttaccgataatacagcaggaataaagatgatcatagatggtgtcgaatgggatttctcaaaaaatgatacggacggatatgaatatctcaatccagcaggaaaattagtgaagtttgagaatccgaaggtttcaaacgtatttttggatgatgcaatgagtaaccgtggacatatctggaataaaacgattcctcttcttggaaagcatgcttttatggggagtggggcaaatacctatatgtttgaagtcccacaggaagattatatcagtcagaactatgtttatggagcaaacagctatgatgtaaaagcccatagctggtatctgcagcagtgggtagaaaccggattactcggtaccctggcacttctggtatttctgttctggtatctggtacagtcggtacgcatttaccgcagagtggatctgcacgagagtatcagctgggttggatttggattatttgcggcagtgctggtgtacatgattgcaggtatcgcaaacgattctaatgtatgtaccgctccggtattctggggtatgcttggtctgggacttgcagtgaaccggatgctcgtaaagaaagaaaatctttttgttaaagaaacagcggtttctgcagaaagtgatactgccgtaaaacagagtattccaaaagcagcagagagtgcaaaagcggataccgcgcagacggtacagaatactcaaggggctggagtgacagaatcctcagtcaggaagaaatcatcgaaaaaacaatcgagaaaacagagaaagaatcaaaaataacagattgaaattatgaaaaaaatcattcaagataaacaattactgatcagacggatttttctgatgtgctacgacgtgcttgcagtgtttgctgcaagcatagttgcgttattgattcggtttgatctgaatatcaaaagcgtaccgtttcaatatatggatgaagtgtggagagcacttccttttatgataattgttacgctggtcattttctggctgctccgactgtattccagtctctggagctatgcgggagcactggaaatgatgtatgtggtttcggcatgtattctggataccgttgttgtgacagtgctgatattgcttcggaactggggggatatgtacccggtgccaagaagcttttacattctgtatggattgtttctgtttgtattggtcatgggatgcagatattcttaccgcggactgcgtgtgcttcgcaatatgcgcagagccggtgtgtacagacgaaatgtacttgtaatcggtgcgggagatgccggaaaccagatcatcaaagaaatcaacaacagccgctatgtgaaaaagaaggttgttggtgtgattgatgatgaccggaacaagatcggcaattatattcatggagcgaaagtcgtaggagatcggagcgatattctggaaaaagtcgaagaactgcatgtgcatgagatcatcattgccatgccatcggccacgcagaaacagatcaaggggattcttgatatctgcaaagaaaccggatgcacattgaaacgtctgcccggcatttaccagcttgtaaacggcgatgtcagcgtcagcaaactgaaagatgtagatgtcaatgacctgttaggcagagatccggtgaccgttgatctgcagtctatcatggattatgtatccagaaaggtaatcatggtgaccggtggcggcggctctatcggaagcgaattgtgccggcagattgctgcacacaagccaaaacagctgattattgtggatatttacgagaatacgacctatgatgtgcaaaacgaactgaaagtccggtttccagagctggatcttgttgtgctgattgcatccgtgcggaatacgaatcgtatgaactggatttttgaacattacaagccggagattatctatcatgcagcggcacataaacatgtgcctctcatggaagagagtccgaacgaggcaattaagaataacgtgcttggcacatggaagattgtacaggcggcagatcggtacggtgtgaagaaatttgtgatgatttccacggataaggcagttaatccaaccaatatcatgggtgccagcaagcgcatctgtgagatgatcattcagacctataaccgcagatcgaagacagatttcgtagccgtgcgttttggaaatgtgcttggcagtaacggaagtgtgattccgctgttcaaaaaacagattgagcgtggaggtccggtcacggttacacatccggatatcgtgcggtattttatgacaattccggaagcggtatctctggtactacaggcgggtacctatgccaaaggtggagaaatttttgttctggatatgggagagccggtcaagattctggatctggcaaagaacctgattcttctttccggtcacaagccggatgaggatatccatatcattttcacaggacttcgcccgggagaaaaactttatgaagagatgctgatggatgaagaagggatgcaggataccgcaaacaatctgattcatgtcggcaggccgattgaactggatgaggagaaattcatgcagcagttggaagaattaaaagagtacgttgtgacagaaccggaagacatccgggagtatgtcaagaaaatcgtgccgacatatcacccggaattggcgggggagaataaataaaaacgtatctatgaagaaggagagaaaacgccatgaaaggataccattatatcaaaagagaaattgatatcatattaagtgggatggcgatcgtgatcttatcaccactccttctttttttatgtattgcgatcaaactggatacaccgggaccgatattatttaagcagaagcgtgtcggcatccaccggagtttcttccagatttacaaatttcgtaccatgcggattgacacaccgaaggatgtgccgacacatatgctggagaatccggagcagtacatcacaaaggtaggaaaattcctgcgcaaaaccagtctggatgaactgccgcagatttttaatatcttcaaaggagaaatgagtatcgtaggaccgcggccggcactgtggaatcaggatgatctggtagcagagcgtgagaaatatggtgccaatgatgtgacaccggggctgaccgggtgggcacagatcaatggcagagatgaactggagattccggacaaagcaagactggatggcgaatatgtcaaacatctgggaccatggatggatctgaaatgttttcttggtacaattggctccgtgctcatgcacgatggagtggttgaaggtggaaccggcgaactgaacaaagaggaagaagagacagaagcgcacaaaagcgaaacagcacagagcagcgcaaaaaagaaaaccattgcaaaagacacagaagaacgtgaaaagggcaggagaaaaaagaagattctgatcaccggaagcggcagctatgtgggaacttctgtggaggcatggctgagacaatggccggagtactaccaggttgacatgctggatatgagaacccaaacatggcggacgcacgatttttcagcatatgatgtggtctatcatgtggcgggaatcgcacatgcagatgtgggacaggtgacggaagaagaaaagaagcagtattaccgtgtgaatacagatttggcagtagagacagccgaaaaagccaaaaaggaaggcgtgcagcagtttctctttatgtcttccatgattgtatacagcggatgtagggaaaagaaaattacaaaaaatacaattcccaaaccattgaatttctatggagacagcaaatggcaggcggatcagaaaatacaggcactggcagatgaacgttttaaagttgttgtattgcgtccgccgatgatttacggaaagggatcaaagggaaactatccacagcttgcaaaactggcaggaaaacttccgctatttccgattgtacataatcagcgttccatgctttatatagaaaatctggcacagtttgtcaaacggatgatcgacaacgaagagaccggagtgtttttcccgcagaacgagcagtatatcaatacttcggatctggtgcagatgatcgctgtggtaaaaggacaccggcttgtgatggttccagcgactggctggatcatccggctgatgaaaaagattccgggaaaaattggcaccctgacgggcaaagcgtttggtgacagtgtgtacgatatgcagatgagtgaatataaggaagaatatcgtgtgtgtgactggaaagagtcggtaagaaggacggaaggataagagctggaatgggaaaatcttgcataaataaaagaattaaagtatgatactactgaaaagatgataaatagcttaatggtatgcattcgaaggtttaggagatagaaaagcgtgagaatagacaaactgcaagtaaagtactttccttattgttgaaacattagagattacgattgacattgtagaaactgtgataggacagattaatagaaagagtggaggtttagggatgccgtacgtgtcacctgttgttgaaaatgattttaaagaccggttgaacaagtgcgtagatattattaaaaattcgagtatcaaatatcagagtttggggatttttggaagctacgcgagaaatgattataaggccagcagtgatatcgacttttgcatcatagttccggaaaaaccggaaagatggatgatgggagccttgcgggaagaactcgagatgttgcatgcggatgtggtttttgtaacaccgcagtatttcgaacatgataattcaaagtttacacaacagttaagaagagattataaggagttgaaaatatgataaaggcaaattcttattattctattgcgtgcaatgaattctggtatttaagggatgcagtgtcacctgtatactgcaatccggctgcagcttcggcacagcaaatcgcagaaaaaatgttgaactctgtggcagaactggtttgtactggaattgaaaaactaatgacatcccataatttgcgtgccttatacgatgagattaaaagggtggatacttccttacaattagagaggaaggatttggcattactcaaagactattattatgatgcaagatatccgggggataattttgttattgtgacagtggatgagctgcgtgaggcattggagatcatgcttgacgttgtagaagctgtaaattgctggagaacgtctcatgaattggagatattaattgctgatccgagaggggagtttcaatcagcgatgagcagattgaaatagaaattttgaaattatgtgaaaacttatatacgcagaatattaatgcattattaaaaaatatggagccatagtttcggtagaagtgataaaaccggttggatgataagtctgacgctgacttgaaaaagtaaattccagtgcaggggtaaattccaccacgctttaaaattctttgattttttagaattgtgggaggctaaatccttataaaacttgaaatactcgcatgtctggcatcctagcgcggggtgtcagatttcatttatagggtacgccctaaaactatgcgcttacggtaaatattttggtagagcgttatccgcagttggatgttgtgaaggatgcagtgattgcagcatataatattatggaggcttcttatgaaaaaggtgggaaacttctggtagctggcaatggagggtctgctgcggatgcggaacacattgtaggagaattgatgaaagggtttaaacttccacgtaagacgtctgatgattttgcagaaagacttgtagaagtggatgcagaactgtgacaggttctttcgcagaatttacagggcgcacttccagcaattgcattggatggacatcctgctttatcaactgcatatatgaatgactgtgaacctttgctatgcttcgctcagcaggtcaatggatacggtactttaaatgatgtgtttcttggaatttccactagtggcaatagtaagaatgtgttgtatgctgccgtaacagctaaagcaaagggaatgaaagtgattggattgaccggacaaaaagatagtgcattgagccagatgagtgatgtgtgcattcaggttccacagacggaaacttatatgattcaggaactgcatttgccggtttatcattgtttgtgtttgatgttggaggagaggttttttgaaaagaaagattaaagtttaacagaacatttgcgattaaaaatttattatttggggaattttgacagcaaatcttgtgtttttgacattcaaattggaacttgagttgaaaaggtataataaatccgtattagctataataatcaaatttaatagtgaatcttcttgatataaagtttataataaagtcaggaggagatggttgtgttacactatgaaacacgaaaacggcttattgatgattcgaacaagaataacaatactttgaatgttgtaaaatagaaggagaatattatgaaatggttacacttgtctgacttgcatattattaaaaaggtaaattgggaagtatttataaaagatttgctacaaagatgtgaagaaagaggaaagattgatctggttatagtaactggtgatttccatgagtttaaagagaaagatgatttttcaaaggctaaaatatttttaatagatttaatagagaaacttaagcttgatataacaaaggacttgtttttgattccgggtgatcatgatggttctaatccaatatgtgatcacaaagatggaaatattgcagttcttaagaaagatgttactcgtattaatggaaaagagtggaacgaattgcttgaacaatttgagtcgtatgaaaattttgtcaaagagttaataccaaagtatcctttcgaacatccagcaggagaacattgtcggacttggaatgataaaataacttttattcattgcaattcagctgttgtttcagatttaatagatgaaaaagagcaattacttaatatagacacatttgccaatttggctatggaaagtcggttgccgtcaattgtattgatgcataatcatattagtgatatacataaagaacaggtggggcagatcaaaggaattattagaaatagtaaaataaaggcatttttttgtggtgctcatcataagcagcagatggatatgataaatgtatcagataaacaaaattgtcaaattccatgtgttggctgttataaatcagcacctgatgcagaggatagatattcaacttgtggggttattattggaacttggattaatgaaaaagcaacacttgaaggttggacatggaaggttgatagatcgtttaaattagataatataatatctggacagacaattgaaatgggggaaaagtattataatgaagctagtaaatatgtagagggtaaggttttgttacgtaatcataaatttagtaatgataagaagctagattatgtaaaaaaatggaatgatcgaatgtttttacatttacataataaagataatcaggttacgatagcaaaagcgtttataatgccagagtgtaggtggctaaatagagattttgatattcttaatggcaatacatttgatatagcagttcaaagctttttaaattatgatagaacagcaacttttttagtggtgggggtacctggtataggaaagaccacgatcacggcatggcttgcaaacaagtataaagatgatgagaatgttcatatattaagatttagggattgggaatcagatgaattaaaatatggattattaagagcaattactaatactttaaatattagaagaaaagatttggaaaatttaatattgattcttgatggattagatgagatgaaaacgcttaatattcgtaatgatttaatgttagattttttggatgaaataagagatttagaaaattttaaatgtattattacttcgagaacggcatatattgatccaaaaatgtttcatgcatcttgtgagttagaaaaatttgatataaataagattaatcaatttagcaaaaaggttattggaaaagaaatagaagaaaaaaataaaattattgtaaatttggatgtactaggaattccggttatactctatttggcacttatggctaatattgatatagggaaaaatcctacaaaaccggaattatattataggatatttgcagaaaaaggaggaatttttgataaattttataaaaaaggaattgaatatgatagcggaagacagatactacgtaattcaaaaaatataaagaattatttaaatgttttaagagatattgcttttaaaatgtttgaaaagaaaagtttgattttatcagtggaagaatgtactatccccaaattagagtttgagagtaataaagtaaacattttagaatttccaattaaatatttatttgaaaattcagaaacaaaaatagaatttatacatagatcaatttatgaattttttgtggcaaataaattgttagaaagttttcagagcgcagataaaatttctaaatatgaattggcaaatgtttttggaaaaaatttatcaaaaaatgtattatcaaaagaaattttagagtttatgaattataaaatcaatgaattaatttcgtttgaaaatatagaggaaactttccagttaatgttggattatggtatgacatattttactaaatcaaaaactaaaaatatactcgaatctgaacaaataatatttgctaatatgcttgaaataatacacatttatggaaaaagcgatttcgattttagaaatctagttatttatattaaatgtaataaaaatatggcacttaatttggaagaaataagaatgcaggatgaggatttaagaggtgccaattttcaggattcaaacttaatgaatgcaaagattaattattcagatctgagaggcataaatgggagaaatgtttatgcacccaaaatagaacttaatggtacggatttaagaggtgccgatttgaagaatgcaaaattacagtgtgcaaaattgtataatgcaaaattacaagtgacagattttagtggtgcaaatttggaaggggcacatttggaatatgcaaatttaagaggcgcaatattaaaaggtgcaatattaaagggtgcaaatttagaaggtgcaaatttagaaggaattaatttggagggggtagatataagtgtggcaaaaataggtgagacaatatttgatgaagaacaaattgaaattttgaaaaaagatatagagttattgcattggaaagttttagtgcatacaacgaatggtcttgtaaactatgaagaatattttaatgcaagtgtctacccacaagtgtctcaatgccattaagccagctgtttgaagttttgttcgataacctagtgtagtgacctgctgatgtttagccaaatatttataccatttactgccgtttcgatgtataataataaaaaaggaacggcggtgatttctatggcaagacgtcaaaaatataatattcagcttacagataaagaacttgtaaaattaagatctgttattcgtaagaaagaaacttcaaaaacgattcgcagcagatgccagatcattattgatctggatgaagtgcatggaaaagttttaactcatgaacaaagtgcaagatctaatggtgtctgcatggcaactgttactaatactgtggaaaaatacatcaatggcggcattgatgccgttacggaattaaaaaggaacataaattcagacaatgcaagacgtaagattgacggtcgtgcagaagttccgttccagaagggcagtctcgttggacaatccgtctgcttgagaaagaatccaaagttattttagaaactcctgttgtaagagatgcaatccgcaatgcttaaaaaaacaaacttcgacctcacaagaacgactactggtgcattcccacaaaagaagacccggaattcatagctcacatggaggatattcttgatgtttacgaactcccctatgctgaaaaacatcctgtcgtgtgtatggatgaaaaaccatatcagcttttaggggagtccagagaatctttgccaatgattcccggaagtgaccggaaaatcgactcggaatatgtccgcaatggaactgtccgcatttttgcttttgtggaacctctcggtggtgctcatcatgtaagtgtccgggaacatcgtacagctgttgattggacagaggagatcaaatatcttgtagatgttatgtatcctgatgccaaaaaaatcattcttgtgatggataatctgaatacccataaaccctcttctctgtataaacgatattcgccggaagaagcaaggcgtatcattaaaaagctggagatgcattacacaccgaagcatggaagctggctggatgttgcagaaatagaactcaatgtaatgacccggcagtgcctcagccgtcgtatttctgatatagaacaactacgccgcgaactatctgcatgggaaatagagaggaatattctggcagcaaaggtcaattggcactttagaaccaacgatgcccgaataaagctcagttcattatatcctgcatatactacagcctcttagtgaggcaatagtattgttaaatatcaacaggtcgctacactggttatagacttttgaaaactaagggaaatatatatatagtttagtttgtgttatatacttatatgagttatcagaaatgatagaagatgcaaatgcataatcatttaagagggaaaagaatatgaaatggttacatatatcggatttacatattgcggataaaacagattggcaagtttttaaagcagaattattaaaattatgtcaggaaaatggtccgattgacttagtgattgttacgggtgattttcataatttcagtgaaggagctgatttttcaaaggcgaaaaaatttttaattgagttgatgggagctttggagcttgacatcaatttggatttgtttttagttccgggaaatcatgatggaacaagtccggaatgtgaacataaagcaggaaatatagcgattcttaagaaagagcctttattagatcacagcttcgagtggaatgaattattgacgcagttcgattcatacgagaagtttgtgaaagagttgattccaaaatatccatatgagcatcctgccagggtacatcatcgtgtatggagagatagaattgattttttacattgtaactcggctgttgtatcagatggaaaagaaaaaaataatcaactgctggatctggatgcatttgcggaaattgcacagaaaagcacgcatccctctattgtattaatccataaccattttgaggatttacacgaacagcagaaaagcaggatcaaaggaatcatgcgaatcagtatgattaaggcgtatttttttggagatacgcataaacagcaggtacatatgatggatataaagccgcaacaaaattgtcagattccatgcgtgggatgttataaatcagcaccggaggcaagtgatacttactcggctatcggagttatcataggaacatggatggatgaaaaggcaacgctagcaggatggtcatgggatgttgcaaagagctttcgaccagatggagaaataacgggacagacgatagagatggggaaaccatttgaattggataatgacaaagaagagaacaatatacagctgattcaggaaatggagtatcaggatgctggagagaagaaagaaaaatcaagttctctatcaatagaaaatgagatctggaataatagaaagctggttgaatttagacaacttatttttaatatgtccgatatgcaaagaaaacaatttaacgataaattaccagaaagatttcgcagaatctcagaaggtgaaacagtagaaagtataaatcaatattgggaagagataattcgatgtggttgtgctgagatttttttagaattactcagagaagtatactaggaggtctagacagatgaatattagattaaaggattactatatggaagcggaattaaagggggcaaatgctctcattatggactataggctgcgtgcgataaatgctgttttggatgagcagtatctaaatgatgaaaattctataattctggggaagtggttgatgggtgaagtacaagaggacacggagacgatattggaggatatagaaaagttcttttgtaaggaggatgaaagcttttgcagggatgatgacaaggagatgaaagtattgtctactgtactgctattggattattgtgaaagtagtgaagataagaaaattcctcttatgttgctttgtgggcgttctattggaaagaaattattgtgtccatcgttgtatagagaatttcgaaaattgattgatgataccagactggaagctcgaaactgtgaagagatacagaaaagtacttataagaattctggctttcaatcattgaaaaaggagattgcagacgcaaagaaggaacaggcagaggagaattttgactataatacggaattactggataagttattgcaggtgattgaaagccaggatgctaacatgaaacaattgcagaaaaataacgaacagctgaaaaaatgtgtaatttgtcagagggaagaatccaatattttgtggtggatgaatggaaagtggagtctcatttaccaaaagagttttacagatatggatgcagaagaattggcgattgcaattccattggaattgaggaggttttcatcctttccgctattaccatattccgcagaatcgattatcggtgcaattatccgggaaaatgcaacacagtcagataacattccttttttgaattatgctaagaagataaatgattcggttataaaagaactgaatgcggtaattggggcagataatattacaaatgttcagcctgtattgggtttgataaaatctatgaaagagtgtggagcagagcctacagtattgaagagcttgatgttgaggaattataatataaatatagaagatatcgaattgacaccaatggagcttgcaaggcatttttgtttggagttggaattggcagataacctttaggcataaaagcatcgaatggaagtgaataaaatggatgatcagagattggatgtaaacgaaatactggataatgaagtagtgatttcaggtgatgaaagcaccgatatcaaggaaaatgagactagtgaggttaatgctaaatcatacacagaaaatgagctgcattcggaagaatatgttgtaatatatagtggaaaagctatgacagaacgcgaactgctaagcttttctgcaagaaacaataatgtgagtttaattatggttgcaggggcatatgcaagtggaaaaacgacgttaatggttatgatgtatcggctttttctggaaggaaaaaataaaacactgcatttcaaaagttctaatacaatgaagggttattgggagcgtggatataacttgatgcagaattccggtagagggacaccagtggtagagagaacaccaagtgctgcaacagatttatttttgaatttgaatgtgttggataaggataagaatcagcataatttggtgtttgcggatttatctggagaaatatttgaaacaagtgatttagcagatagtgccttggagtgttttataaattcaaaaattgtatggcttgttttagatggggaaaagatgggacatgcagacatgcgtagagctacattccaagaattttctattatgattgaaaatttaattcatcatggatacatatcgaatagtacgaagttgctgttgatatgtacaaagatggattctgtgacggataaggattcgaaagcatatattgatgaaaaattagattttttaaaggcaaaatatgaaaaacttgtggatgagattaagatgtggaaggtttctgcaagaaatattgatgatgaaaaacaaagtgatacgttggaacagattatgatggagagctttagcaataaatgcagtgatatccagatggaagacataattacagataacaggggtgcattgcatagagcatttgaatattatggattgaggaaataatatgcatagggatttttttatggcaggaatgccgggaagtggaaaaacgacatatctggcatctttgtggacgttattaagtgaaggatgcgtttcaacaatgtataaaaaagaagtaggcgttatgcctgaagattgtgcaacgctcaatcagatagctcaagaaatattatcctacaaagacattgaaagaacaaaaatcggcgaaaaagtgaagctatctattccattaaaggacgagaatggagccgatgtttttctgcgtattccagatctggcaggagaggttttcagaaatttggttgaggatcgccaacttccaaaagagacggtttcgaggttgcgggaagcagattgtattttgttttttacgtattataagaatatgtcttatgaaaaaagaatagtggatgggagttatgatacagtaaacagggaatacacaaatgatgagaataaagacaagcaaacgtcagcaggtttggataatcaaatcaacaaaaaaagggacgcaaatgagtcggaagtggttgagttgctgttatcgctgctggagttattaaagaaatccaagaaatcagtaaatatcagatttattatgtcagcgtgggatatggtggagaaagaatatggaaatgaaattctaccagaggaatttgcgaaaaagaaatttccattgttgtatcaatgtatatatagcaatcgggatcgaatgaactttgagttctggggagtatcagctataggtggcaatttggcagaccgagatgatataaagcgtatacagagtgaagaatcgaaggcgattaaagtggttgcaccatcgggggagcgatccaatgatttgactgtattattaacggaaatgggtgatgataaatgattattgcagaccaaaccttgcatggatatgcaaatggacatcaaatgattgcctcgtcttacgagtggaatcttgaagctcgtagaaagatggatatcttaagcgatctaaatagcagatgtaataaagaggatctatcatattatatgggttatccaatcaatgatggaaaacaatatgtgatcgctaaaacgtggtatgcaggtgaaatgtccaggccagggtgtgtgtggacacattctcttgtttttgcaacagaggatgtatcgaaaataagtaattttcaagatatcatggctgcttttcgtagaccagaaaataataattatgaaaattattcgggaaaaatcaaatttgaagagggcaatgatgttgcttttccatctaatagtggtctgctggagtatttgatttatacaatatatagaacggttaatccgagaattgtttcctttgataatgatgaagcggaagcagttcaggatttattcttttgcattcacagtatgccttatcaattattgaaagatttttcatttacaacaatggcatatgaaattagatcctacgatagaaagctctttacctatcaagtgacaaccaagtggcttgtggaggatttgaagcgaagaactcctaaaatagaagtttgtgtgccatatactgcgatagagaagatgccatattgggtaagttgcttttgcgattatttaaaagagggtaaaatagacggattgtacagttttatttcaaattatggtgagcagtattttgagtggcgattttttaatggatttatcaggatgtattttcttttacaaagtcagaatgaattgatgcttgatgaatatatacattatttattgagggttattcaaatggaagacgacagtctgtcgcagcgcacgatagatttgattctggaagatcgttttttgccgaattcattttcagatgttgcgtatcaaatattggagaatctcgacgtgggagtatttaaattatcaaaaaaacagaacgaaactcttttgaataaaatattggaaggaaaattggaaaatctgtttccattattatgcaaatataaagagggaaaattaaaacaaaataccagagagatattggagagaattgttttatctttaaagccgaatgatttgaaaagggtaagtaggatggatgaggatatatgtattatactggtacgtatgaatcacaagctgcttttgtcagaagatatttggaagtcgagcagagaatttcagatttcaatgttgtattcggctggaaaatgggacaattcccaaaatgttagtaaattattgaaactggtcattcatgaatataaagcaaatgtttctgatgagatgtatcatatttatggaaatgagatgatagatctggtattagagataatcaaagaggaaccgatgtttgatgagtatctgatacaatggtgtgccattgcaaaaaaggaaccggatcatttaatgaatgcattggtcggctttaaatcgagagaattaagcagatatcttttttgtgaattggatatgagagatgaaaagcttgtcacacaggtaaatacgagtgtatgggaagcgttgtttgagacaatatttaagggtgaaacaaataatgtctggaagaaaaaaattggtctgcagtatgtggttttgattttttctatagattatcgttttcaaaatgaattggtggcaagtgttttaataccaatttataatagtgcacttaggaattcgttagatatgaaggattggtattattttcaatatctgttaccagaactggagccgtgttatgcatgggataaatgtaaacgcatcagggaggcactaaaccagagggggtacaaaataaaagatattaatgattgattttattcatttaaatattgagcgaacttgatttatccgttatactattagtaggaataaaaggcaatgccattaagccagttgttcgaagttttgttcgatagctcagttgttgtcaaatatccgatattttgaactcaaaaagccaaaaacaggtatgccaaaaagacagatgccgttcatctgccaaaaagaaggatattcagttgcagaacttaccgatatccaaaatgaattgcgctgattccacggagaggccgttgaaactgccggaacctgtctttcactgcgtggacatatataaaaggggtctgaccccattaaaaaaatataaacttttttaatggggtactgtttgccggtattacggcatccggagcagatgcatttttgctgcatgttaccactacgccaagtgtggcatatgtagtccgtgatttctctgtctaccgatcttacgatggcatgcgcgtgggaatggattgttccaacggaaatacgtttaacattgcaaagagtgtgtttgatgcgcttggtaccaaaacatatgtggttggcatgagctggacggtaccgacatcaatatgggatgcggattggtgtattgccgtggatgaaaacggtatggaagtgcacgaggattatatcctgtatgtatgtgggaagtatctgaaggaatgtggccgtctgcagaataatacggtggatgccacgatcatgtccaacatgggattgttcaaagcaatgaagcgggagggcatcctcagacctcacggtctgggcgatttttctgtcaggggagtttttttacagccccctatataacgtatgctgttacacttataaaattgctgtttccaaaaaatgctgaatgtcctgaaatgaagaaaaaacagcagtcgcctctccagtatcctgttttattcctgagccagtataaccaatcacatcaattcctgcctgtattgccgcatgaataccggttgaggaatcctcaattgcaacaacctcatctttttcagcctgcaataactgtatcgcctttaagtacccatccggatagggctttcttttttcacacatatccccacatacaataactgaaaaataatctgtcattttgatccggtttaaagccgtaataatatatttcgcgctcgttgatgttaccaatccggctttcagattccgtcccttcatccattgaaataattcctgtaatcccggcatgggacagatggcatcattttcataggtatttcccatctcttttcttcttttctggtacatttcccatgaaacattttctttcgaccggctcaaataatgcaatattttttcacggctgttaactccaataaatccttttaactcttcgtgatccatatatacaccaaacgatttgagagtttcctgcagataatgagcattttgaggttccgtgtttacaataacaccatcaaaatcaaaaagaatatattgtttcttcatataaatctatcctttagttatgccagcagccgtgatgctttttcctgaatccatgctatttcttcttccgaaagatcacaaaaatcgctgttttccatagagcaattggaatcttgtacatatactatttttgtatctttctgggtgattgaataaaaccagcattctgccggaacattatatacttttccctgctccatcaatgtcagatcaatagaaaaaccattttcctttttttctgcggtaatcagaatcgctttaccatgtacaagaataaactgctcatcggtcgaatgatggatctccaagtgtttaatcccattaatatcattgtccggtttccagtttttaatacatacaagccactttggatttttatagacacataaaattccctcttcgttattttcatacatctctggtttcatacttatacctccctaaatttctgttcttcctgtaattggtactccatatccaaatgcaccttcttttgcgcacatctttgcggcaaactccgatgcctttttcattgcattttgaatttttacatacatctgttcatctgaaccatctaaaatcttatgttgtggggaattttttaacatatcacttaggaatgccgcaaaataagaatctcccgctcccatagtatctataacatcctctgccaatactgcttttgtatataaaaatttatctttatataatacataagagccttcttctccgacagttccaagaacaacagaaacaccatatttctgtgcctttttcatttctctctcccgttcatcttctgacaaatgtgcacatgacataattgcaacagttacatacggacatacatccctcaaatactcatctgtccagcgcattgaaaaatcataggcaatcggaacctttgtctgatacaattttgaaagatcctgttcaatatagctgttaagatttgtgtaaatcaaatcatattgctgaatataatccatatcttcttcgttgaaatcaaatgcatgatcttttgcaattccacctttatttgagccaagaaaaacacggtctgtttctttcagtgttaccaaagcgaaaccgttttctccctgaaaatgccggcaatgcgtatcatcaatctctaatttttttaatgtctcctgcacacattcagcaacttcatcattaccgtattttccaagatatgccgaattgacaccattccattttgcatatacgcatgtattgacacattgtcctcccggatacattttcccacgagataaatatttatcacatacattatctccaatcgctataatttttggttctttcatagattttctccttatgttttaaaatactactgctcctatcaaaattgctgacactactgaaactacagtacatacaaggccaggaagcatatagctgtgatttaacacatattttccaatttttgttgttcccgcggtatcaaacgcaattgctgcaacgcactgaccggaagcaggaataaaataatttgatgaacatgcaatccagccagcaacaataatatttgccggaagccctaatgcaataccaatcggaaccataatcattgtagaggatgactgacttgttgttattgccccaacaataaacactgctatgatataaatccatggatgttcattcgtgagaactgacatattatctgtaataaacgatgactgatctgcaataaatgtattcaccagccagcaaagaccaaatgccagaacaacagcaaacattcctgttttaaatactggctgatccagtaccttattgctgtcaagttttgtaattaataccgttacggctgctgcaaccagcataaaaatctcaattactgtggtaagcggtaatttgcttccatctgaaagtgttggaactaatgcactcactgcgccaagcaatacaatacctaccatggcaaccaaaaatactgtaacagagatttttgcctcttttgttgttttaacttctgcagcattctcatttttcacaagagtctgaacctgtccggatgctacacgagcctgaaattccggatcctctgccagttcttttcctttcttcattacagcaagagcacatgcgactgtaccaatcagtgttgccgggatacagactacaagcagtgtaaaaatattaaccgttttatagttcgttgcttcagccataaaagccagaatacctaccgttgctgctgaaatcggacatgccgtgattgcctgctgggaagctataatggatgctgaaatcgggcgttccggtcgaactcctgtctcaatagaaatttcattaattaccggaagcaaactgtaaataatgtgacctgtaccacacataaatgtaaaaatatatgctacaaccggtgcaagtaccgtaatcatcctaggattcctgcgaagaatcttttctgctatgcgaaccaggaaatccaatcccccacatgcctgcattgttgcagctgctacaattaccgcaatcataattaaaataacggtaactggcggatctgccggtgtaacatgaaagaaaaatgtcataattaacattccaacaccaccagccattgctaaaaatgtaccacccttacgtacccccaaaaatataatggcaagtacaagtattaattctacccagaacatattcatgtcctccctctcttatatatatatctttttcagttacattttggatgtgcgcatatccgtacaatacaaactttaatacaattctcgtacatcgctcttatttgtattgttttgtatctgctttaatattatatttgtatcatacctttgtcaagaacttgtgtgtttttcgtcaattatcctatattttagttccaatttttgtgcatatttttgttctcaggctatttcagtatcgtatctgtattattttgtatctataatacaataagcagacaaaaacataggatacaatgtctttgtctgcttataaattcttttgcccgaattaaatatgttctgaattaatactctactttccacatatatctacgtgttgaaagcggatgttctttcttttcagccagttcatggttataaataggatatacattattaaacagtgaatggttaaagtaatccacaacagaagcatcaattgtagataatccaagttcttttgcgtccagaacctcaatcctctttgcatatgtatgaaggaattttaaagccctttcatccagttcacgggtagatccttctgatatctgaatcataaacggacggtttgcatctgtgatttcaaacggtccatggaaatattctcctgtatgaatactgctggaatcaagccactgcatttccatgaaaatgcaaatactttccatatatgcagccccatagccggctccgcttcccatcgtataaataacggtatcgtccttgtatgtttcagcaaactgttcagctcttacctgtacatgttttcttgcattccggataattccggtaatcataccaagtccttcgtagaatttatcataattttcatatcctgcggtctgttgaagtgtttccactgctacgagcagcgcacacattgttttttctccagcataatcaatatcacctttgagatgatccggacttgcatcaaatgaatactggataatatagtcaccaaactccacaatttcagattcttccagccatgtaagaataattactgctgctcctttttccttaccaagctttgctgctgcaatcgtttccggtgtatttcccttatggcaggacagacagatgatcgaattctctccaaaatcttttggtgtactgtgaacaaattcgttgctgttgatcagcgcggatttaatatttgaacactctttctccataaatgtttttgcaggatacaaagctccaagagaccctccacaaccaacaaaatacaggctcttaacacctcctttgtcttttttgttctccaaaatctctgctacaatgtttttaatgtctttgcttgtataactcatattcatttctcctttttttatttgtctcgtttgtttctatccaaaatataatacaatataatacatttgtcaatataaaacagcttttaaaataaatatatacaattctgaaactttgtattataatatattgtataatacaaatcaaaacacattacgaggtttttcatggaattaaacaatacaattgccaaaccactatacaaacaacttgaggatcagttaaaagaagagattgacaccggaaaacgtaaagcaggcagccgtcttccaacagaaaatgagttaagtacaacctacaatgtcagccgggtcactgtccgaaaagctcttgcaggtttatcagaattaggatatctggaccgcaaatccggaaaaggaacttttgttgccgaaaaaagaatccagcgaaatatctcaaaaggtgttaccggattttctgaaatgtgccgtacaatgggagcagttccaggtgcgaaaaccattaaaattgcaatagaagatcctaccgaaaaagacatggaactcatgcatattacacccgataaaaagattctcgtattggaacgtattcgttatgccgatgaaaaaccggtattgttagaaatcaaccggtttcctgaatccttttcttttttatttggagaaaatttaaatgacacttccctttatgatgtgctgcaaaaccacaatattatttttgatcattccgacaaaactttagatattgtgtttgcctccgcacaggaagcaaaaattttggggatttcaaaaggttatccacttcttcgaatcgagagtacaatctataatactgattgctcacttgttcaaagatgtaagcaattatgtatcggcgataaatttaaattcacaatttaaaaactccgggcacatatacatttgcgcccggagttttatattattccatggcataccagataaattccgggaaaatcgcccgatacttctatctccacatttcaagaaacgctttcacttcctccggcatacgtccctttcgccacgcgagaagaagttccgtcgtaagatccgcatccagaatatcacaggacttcatctgatccgacaacttgtgcatagaagccggaagaatggcgatgccaagccctttttccgccatggtcatcgctgttctggcatcctcacactcacaataaatatcacacaaaagcccctttttttcgaacgcggacaacagataactgcggtagcggtgggacaggatcagtttctgctctgacagttcctcgaacgtgatcccatctttgtttttttctaaaactgggttccctgcagccgccattgcaagcagcttttcctgcatcaaagtcctgctctcacatcctttgagcacaatcggtgtccggagtgtcgtgatatcgaccacgccgttttccaactgctcccgcagcgtaaatgtcgatccctcatggatatcaaagcgaatatccggatgcgacgtggaaaaacggatcaggtaatcggacatcatagaaaccgtggacggtgtaaatccgatgtggattgttgccgcctggcttgcctttatgacttcccgcttggtaatatccgccatggtaagaagactgcccgccctgtcatacagtgtttttcctgcttccgttaatgtaatctttttggtgccccgcaaaaaaagctgcacctgaagttcttcttcgagcatctttacctgataactcagcggcggctgtgtcatgtggagaacgcgcgccgcaccgctgatcgtaccggcatccacgattgcccgaaagtattccagttgttttacatccatagcttctctccatacattttttgtttagttaattcataaaagtaatatttttcatatatgttaatctatggtatactaaatgtcaacagaaagtcaaaatgaaaaagaaagaaatgaaatgattgtgaaaagaattgattttgaacatggttccataccaagcaacatcttaaacgcagcgattcccatgctggttgcgcagcttttaagcctgctttacaacatcatagaccgcatttatatagcaagaatcccgcatatcggcacaaccgctctcggcgcggtcggcttatgttttccgattattgtgatcatcacggctttcagcaacctgttcggcagcggcggtgctccgcttttttccatccggcggggggaaaataattcccggaaagcttccgaaattatgaatacctcctatacgatggtctgcggcggcgcaattgttttaatggtcattggatttttgtttgcgcgcccgatcctgcgtctgttcggcgcttccgagtctgctctggtttatgcatacccgtacctgatgatctatctgctcggcacacttccgtccatgatctccaccggtatgaattcgtttatcaacgcgcagggatatgccatgaccggcatgacatccgttgccatcggcgcggtggcaaactgcattctcgatccggttttcatcttcgtcttttcgcttggaatccggggtgctgcaattgcaaccgtgatttcccagacactctccgctgcatttgtcctctattttctgaaaaaacgatcggagcttaacgtacggtttctgaccagaagcgaactctcccggtgcacggaaactgccaaaaacatcgtaagcctcggaaccgcaggatttattatgcagcttaccaacagtttagtcagcatctgctgcaacaacgtactctccgtgaccggaggcgatatctatatctccgtgatgacaatcatctccagcgtccggcagcttgtcgagacaccaatttatgccatgaatgagggaagttccccgattttaagctacaattacggggcgcgccgcccgaagcgtgtaaaacaggcaattggtacaatggcggttatgatctttgtgtataccgccgccatgtggtcggtcattatcgttgcaccgcatttccttatcgggattttcagttctgacagcgagctgatcaaagacgcggttcctgccttaaaactttattttgccgcatttattttcatggatctgcaatacatcggacagaccacatttaaatcattaaataaaaagaagcaggcgatttttttctccctgcttcgtaaggtatttattgttgtgccgctgacctacctgctcccatatgcacttggcatgggaacaagaggtgtgtttatggcggaaccggtctcaaatgtgatcggtggaagcctgtgctttttcacgatgcttgccaccgtgattccagaattaaatcatatggaaaaacaaaaataagttaatcttccatacctgcgcgcagcgctgcttcttttgcttttacgtcggaaaggaaatgctcttttgcaaagcccatatcctgcaccagctccatggtcccgagatatgtgcctgtggcatcccgcaccgccatataggtaaccagcatggtttttccgtttttctccatccagatcggcactttgtcgagcgtccccttccggaattccccgataatgtgacgcacctgctgctccactttcggaggatggcaggaaaatacctcgcggtcgatcgccatgcccggacgtttgaaatcctttggcccttcattgaaaaagcggttgatattgtcctcatcgacaaatgtgatctccagaggaatcgtgttgagcattgcggtaagctgcgcaacggtcaggtgcccgcccggcatgatgatttctccattccttacatgtttactgcaattttctgtatgcagatacttctctgccgcctcccatgtcgcattttccacaccaaagcagaccggataatctttcgaatcgcggtaaattccaaaccactcttcctccgtgaaattcagggcacagttcgggaagaaaatattggcttccttgtagatcatatcctccacgcgctgcaacacaatgcgaaaacgttccagccagtgatcttccgtcttttgaaccggcagctgctttgccagcgctgccagttcatccctgatctcatcatcggttgtccacatcacatccgacgggccgctgatcccgtattttactttcagatgcggatacagaagatcccctttctttgcataatggatcgcaacttcccgcagctttccaaacagctccggtgaaagggtattggtttcctctatttcgttcctgcattcccggatgacgttttccaacacttcattttcgtgggtaaacgtctgcagcggatgtccggtgattccggttaaagccgcggtagccgccagctttttctcttttaccgatgccgcaaccgctttttccgcgttggcaactttttcctcactcgttgcgccgcggaacagtgccgcatggacatcacacaatttctgcacggtctcaagcggtgtgccaccctgcagaagttcctgctccgcctgcataatctctgccggatcaaccgctttaaattcttttgcgaaatccgcccttactttttccaattcttccccggcgctcagccgctccagatatgttttgatctgttctacccgcttgttgtgttccatgattttatcctttcccatttatatagactctcttacaaacagttttttcattcttccgttacaatatacacaaaaacaggaaaagaatatgttgttgcaaccacattttatttttttcactgcagtatttttatgtctcgcttttaatcaattgaaatacaaatttctgggaactgctgcctgactttggtgcataaatcagatgttctgtactgattgatttaaggtacgttccttattggaactttcctgacctacgtacctattatatcagtttcagaccggtttgggtttcgtacgacatgaattacagttttttcgacatgaaagatatgggttctgcccgactccggcagcggttcacatcatttaccacatcgcgtgcagcacttctccctcttttatattatttgacgcacgtcaaatataacttctaatatcatttgacgtgtgtcaaataatatgcatacttcttttattcaccagttccactccgctgttttcatgttataatgaagcatgtcatccggttccgcctggtgacctgtaatacaaccatcagatatcaggaggagagtatacatgaacgttgttattgccatcgattcttttaaaggaagcatgacttcccttgaggccggggagagtgcctctgccggaatccggcgcatatatccggatgcagatatcgccatccgcccacttgcagacggtggcgaaggcacggtggacgctttgacgcttggctgtggcggcacatgcacacaggtatgcgtaaccgggcctcttgaaaaaccggtactttgcagttacggcattctggatgctggaaaaactgcagtcatcgaaatgtccggggctgccggaattacactcctttccgaaaccgaacggaatcctttgtatacaacgacctacggggttggggaagtcatcagagacgccatttccagaggctgcagacattttattataggaatcggcggaagtgccacaaacgatggaggaatcggtatgctgcaggcactgggatttgacctgctggatcaggaaggggttccggtacgtcatggtgctctgggcttaaaggatctggctgtaatttcagactcccatgcgctgccggaactgaaagaatgtacgtttcggattgcctgtgatgtgacaaatccgctctgcggttcgcagggatgcagcgccgttttcggtcctcaaaaaggcgcagatcctgccatgatccagcagatggatcagtggctttcctcctatgccgcactcgccggaaaaagctttccgaaaacgaatcccgcgcatgcaggagccggggctgccggcggtcttgggtttgcttttctcacctttttccatgccactctggaatccggtgtaaacatcattctggaagaaacacatctttccgactatataaaaaatgcagatattgtcatcaccggagaaggctgtctggatggtcagaccgtcatggggaaagcgcctgtcggcgttgcaaagattgccagagaatttcaaaaacctgtgcttgcattttccggctgcgtgacagaggatgcaaaagcctgtcatgcagcaggaattgatgccttttttccgattgtgcggggcgttatttcgcttgaagatgccatgcagaccgaccatgcaaaacagaatatgaccgatacggtggaacaggtatttcgcatgcttcgaacgtttcagaatataaaataatgaagcagattggtaaatccctgttcggttgcatatttctccagcattttcttctggtttatgatactgttgctgtcaccactttgctcatcatcacggacctttgcggaattttcgttactgttcagaggtaaacttgtaacaaaagaaccgatggtatagactaatcgtagttttataaggatttagcctcccacaattctaaaaaatcaaagaattttaaagcgtggtggaatttacccctgcactggaatttactttttcaagtcagcattctcatgccctgccaggtactgaactgtcttagggtcaacgcccgcatagagcagattcgtgatgtaggtatgccgcaacaagtgcggtgttacatcgaaattcagggtatagcgaatcttgggattgttcctctgcgttgttcctaatgtcggcttgacggtatatttgatgctctgtccattcacatatttatagtaagttctctctttcgcagaacgaacaactacatactgccaaactctcgtaaactgagaataggaaagcggctgtccctcactgtccgcaatcacatactccgatatggaattggcttttgcttcccgcaggcagtccaccaggcacttcggaatgggaatgtcccttttagctgcttttgtctttagaacggtagaaatcaccggcctgttatgctccgcgcgccatgcacgtctcacggaaatgtatggtgtggattcatccaggaatacacaatcccattgcaatgcaagaatttcttcccgacgcaagccggaatacaaaccaatcataataaaaagatatggcggaagctctttcaccgtatccaacagaaccgcaacctgttgatctgttaaggcatctttctttttcgatgcttttccgccctttgctgaaattcctacacacggattatcggttatcagctgactgcgctctgccgaataaaacacacacttaatcagcatatttaccgtatcatacagtcctttcgatttttgagacagcggaacaagcgccagacgaatatcatccgcagtcacttcctccatatacatatctcccagagagttgatgacataattcttcatattctgtctgtatccttttatagtggccgtagacacctttgctgactgcatcagcagccatttctcacaatactcggcaaccgtcggatgcttccggcgaaagatgatttcctccacctgtctccggccttccaactgcttttcatataattcttcacaggtggtcgcatataagctgacctgctttccatcggcatctgtaattctggttctgtaatacagtgttccttttcttgtaaccgttccgtactctggaacgctttgttttttcttagccatacaaatcttcctttcctgataatgagtgttcttaaattcacaccttctttttatcagaaagcactaacttaatcaaagatacggattatgaaaaacaaagagcgagacatccttgcctcgctcctgcgttgtttcctgcttttataatgttatgcctgtgctgcatcccactgggcaaatgcaccacccattgttcttaccagctcatccggtctgttgtatttgacctttgcgtaaatgtccatcgtaattttactgctctcatgtcccgccaggtattgaaccgttttcgggtctacggacgaatgaatcagattcgtaatgtatgtatgccgcagctggtgcggcgtcacttcaaaatctaagctgtaaatcacttttccgttatgtgctgccttttcaccgaggaccggcgtaaccgtgtgctttacacgctttccatcctcgtagcgataatagaaacgctccttgacagttcgggtcacaatatactgccagagccgcttgaactgcgtataggataacggatcaccgtctctgttcgacactacatattctgactgtgaattagcttttgtctctttcagacagtccgccaggcaaaccggcaacggaatatttcgatgcgcggctttcgttttcagctcatccagaatcaccggtctgttattttccgtgtgccatgccctgcgtaccgttaaataagggcaatccacatccagatatacagaatcccattttagggcaagaatttcttctcgccgcaatcctgcatacagccctaacatgacaaatacatacggcggaagtccctgaatggcatccagcagtctggcggcctgttcatccgtcaatgcagctttgtccttctgcggaacgcctccacctttggctgtaaggtaaatcgttgggttgttatcaataatcttactttcctttgctgcacggaaaatggatttatacaggataaccactgacttatataccgaagcggacttctcggaaacaggaacaagtgcaagctgaatgtcatccagtgtcacatctgccatccgcatctgtcccagttcttttataatgtgccgtctgacctttgaggtataatctatcagcgtggttgccctcacatgaaccgactgcatcaaaagccatttttcacagtagtctgcaaccgtcggggatttccgacagaatgtatcgttgtcgatctgctctaatgctcccaactctttatcatataattcttccggtgttctcgcataaagggccaccagttttccatctgcgttctgaacccgcgttctataataatctatgccgttaagcgtaactgtaccgtattgtggaattgctctttttctttttgccaattccgtcacctcctaagaatagactccagcgctgtatctatgttttatcagaccattatgatttcgacaaggatacggaccggctcacactccagctctgcgaggtttacgataagttgcgttcttttctgctggctttgctctgtgggtgcattttgcgatatactcctgaaggcccgctgaagtaaagtacacacagccattctgcacatattgcacataagaaataagaccattgttacgggccgcgtccagcgttgcaatgctgatacctaaaatttctgctgcttcttttcgtgtaataagtttttccataaagcatatttcctccaatctgtcaagtttgtcatcgtgtttgttcaaagccacatgaatacgctggcagctgaaactgcccgcgcatggtatctgattttgaacaggaagctgcaaacgcttcctatttatataactcagctttcatcacatttgccacgccccctgacgatgggaacacaacaggtctccgttggcgcggctgtcataactccgcagcaccgttcgtatcgtgtgccgcagggttccccccaagtctttggcgggccgtgaggaagtatctttaagcccccatgcagtcatcgcgccggatctgccacaatccgttttatgaaatcgtagatcgctccgaagcagtcttttcatcacctccctgactgctccatcttcgcggcgtttcatattcgctcgtacatgggttatgtacctgttgtgctgtctattcgattgtcaatgtacttgatgaaggaggaaaacttgtccttcttattaacactgacaaaaaaagcaaaaaacaggcgcatcaaatgaaattttatcaaaaatattttacaagctgctttaatccacggcggatactgtctcggacacggcttgggtctacaccttctacttcggcaatttcatttaccgccattcccagatagtatcgggcataaattcgctttgcctgtttctctggcagcttcatcacagcggtatagacctgctcctgaaactgtttttcctccagaagcatctccggtgtttgcagcttcaatagcaccgcattttcaatgccattctcgcaatccagagaatactgtgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccgacaccggcagacaaccgggtcatctccgaaaaaatggcaacaaaaaacgccaacttcccataacgggaaatcggcgcaacaaaaatacctactattctgctgatttagatggaacgataatactgatagatagtcatactcccccggaggaggggcaagactttttttagctggtgtaactcatggctattgtgaatgacaaaaattgacacggcggcatcctcctatgtgccgccgtaccagattacagggtgtagggtcgtcgttcattttagatagacgaaaggaaacggcggctctgattttttcaaagccaccgttgcaaagtgcataacaatatagtcgctgtacgatggctttttttcttttgccatcgtgcggcaactttttcacttttcttttatcttaacaggcaatcctcacagaaatgtcacggacatactccatttcgacaaaataacaagctgaaatctcaccaatctgtgagatttcaaattttttgaggaaagccgagaggaaatgcctcctcccggctttcaataggtttatgattatctattgtagcaatctctgtcgttactccgaagtcctcagccgctccaccacagttcccttgttaaagaagtggagaacgatcagcggaataaccgcagccagcagcagataaagcacaccaatgaccagaaccggaaccaatgtaatattcagagtaaagaaccacatggaagggccattcaatgcgctctttagcactgtgactgccaggatcgctgcgactgctccgccgataatgtccgcacctacggcatagtagatgccctcatagaccgtcaagcggcgaagctgcttgccggtcataccgatgctctgcatggtagcaaactcatggcggcgggtgatgatgttggtaataatcatgttggcaaagttaatcagtcctgcaaaggccatgatgcaaccaatcagaccgccgataaccaggatcatgctgcggaccgaatcaagctgctctttcaacagcttggtggaagtataggcaaccgaagtattttcactcacatagctgctcaaaaattcttccatctgcggctgcaaggcttcatccacattgaatccataggtcagcagcgtgggagcgtcatagatttccttaaatacagtgtccggcagatacacaaaaggagcatcagcggcgatgtgcgcctgggcggtggtgcctgtcggcgtttcggtttccgttcccacgaggatcgcttttgcaaggatagtgctggttttgaccagttccccatccttgtagaaggaaatgctctctccaacctgtaactgatcggtcagcggagtgttccttggttcctctgtcagtttgtccatggggcagccaataatgacatattctccggtagccattttctgcgttaaggtttcggcatctttttcgccttcaaaaatacgcatatcagcccagaaattttcggaggcccccatcacattgccaaaatagcgcctttcggtatcagaacttgtgtacaggctatatccctgatagctttgatttacgacgccttcttcctcatgaaacagctctatgccgcttaaatcttcaaacccatagtcaaccaatacatttctatcgtcttttgtatttcggtagagatagcgttcatcctcaactccgggctgtccggcaatcagatccaccgcctgttgtgagagcgtatctttatggtgctgaacgctttccattacattaaatgcggctgagttatagatattaaaatctgttctggtgacacggtttacccacttttcttcatcaaggctttgcgtcacaatgatgatagagttaaacaggacgatgcacagaagcagggaaataatgatgaacgctgaacgccgacgattgcggcccaggttggaaaaggccatacgggacagctttaccccattggttcgcttggcacttctctttttataggcgttctgctcggtgtagcgaatcgcctccagaggagaaatctttgccgccttttttgcaggcttcctggtgctgataaacacggtcaggattgtaaagagagcggcgataacaaaaattagcggcgaggtcgatacggatgtacccaccatagagtattcaaggttaatgatctctgtcacgataggaagcagcacccaaccggcaaagaaaccggcgatcagaccaataggcagtccgatcagcgtgagccagaccgcctgacggttcacaatgcccttgatctgccgtgtggaagtgccaatcgtccgcagcaggccgtattgacgaacatcctgcatcacagaaatatcaaagatattgtagatcagcaggtatccgcacacgacaaacatcaggataaatacaacagcaaacacgatggactctgatgaagtcactccctgggacatttgattttcagaggcgagaatgaaattgtctgcgcccatatcctctggattgccgccaatggagtaaacgaactcattcaactgctgctgaacatttgctttattcttcagcacgacatcggaaaaagtaacgccggacatttcatggtctaccgcataagtgttctggaccacatcggggttttcctttataaactgctctgaaacagtcgcaacgctcacagagtcattgcttgcttcccaccagccggaaagcaccatatcataatgataagttttcccccgcagttcaaattccagcggaaccgctgcgccaatctttggttctacacccagcgccttcagcgccaaatccgtggtggcgatctcattcgctttctccggtgcagctccgtgagtaggcacacagaaggtcagctcctgctgcacactgtccgcataattgatctcaatggaatggctggaagtattgcttgcatagccaatgatgcgccggtgacctgcctgctccacaaaatcgctgtttacaagctgctcgtactgttcctccgtcatatatcctaaagtgccatccgccttgctgcctttctgcatttgcagagagagctggatggaggacgccatattgaacgccagggaagtgatagaggtaaataggaaagcagtcaggataattgccagcagtgcagccagattgcgtaccttattctttttgaaatagcgtttggatagcttggtaattacttcggaattattgttgccaaataaaatgtcattcatagtcccgccccccctttactgcacgatcttaccatcctcgatccgaatgatgcggtcggcaagctgggcgatctcactgttatgggtaatcatcacgagggtctgatggaatttctggcttgtggttttcagaagccccagcacatcggcgctggttttgctgtccagattgccagtcggttcatcagccaggacgattgcaggctttgacaccaaagcgcgggcaatggctacgcgctgctgctggccgccggaaaggttattgggcatattgttcagcttatcctccagccccagcatctgaacgacttctttcataaacttcttgtctaccttgtttccgtccagctccacaggcagcacgatattttcgtagacattcagcaccggaaccagattgtagttctggaagatgaagccaatctttctcctacggaagatggtaagctgctcatctttcaatgttgagagttcacgtccatccacaataaccttgccagaggtcggcacatccaacccaccaatcatattcagcagtgtagatttaccgctgccggaggttcctacgatggcaacaaattcgcccttttcaatggagagggtcacaccatccaaggctctggtaatgttcggttttgcgccataatatttttttagttcagtcgtttgcaaaatgctcataaagaacaccatcctttctttttgataaacccattgtaacgaccaaacctcacagaaatgtcatgagccacaaaaaatttctgctaaattcggccccaaatgtcacgaacctgtgacatttcattttttcggggcgtgcctgctctactttcggagcaggaaaacagaaaaggttgagcctttcccaacttccgataccacccggatataaccgccctgcaaggtcacaatctcacgagccagatacaggccaatcccaataccgtccacatcatgcaccgcatcttcccggtaaaaccgcttgaaaatcgttccctggtgctgctctgaaatgccaatgccggtgtcggcaatgtcgatcttcacatacatttcccagccttccaccgacacatggatctgcccgcctgccggggtgtacttcactgcgttatccagaatgttaaacagggcttcgcttgtccattttctatcatggcgtgcatccaaatgctccgggcattccacctgcacatctatttgtttcttttcggcattgagcaaaatcccgcccagggcagcggcaagggtatcataaaccggctgctgtttttgctccagtgaaatgactcctgtttccaggcgggaggttttaatcatggcttgcatgaggaagtccagcttatcaagctgtctggcctgggctgtcagaaattccttttgcttctgcgggggaacctcgttttcaagcagcgtgttgttgatcatcttcaagttggcaatcggggtcttgacctgatgggagatgtcagaaatcagctcttgcaggtcagcccgttcctttgcgatgctgtttttattttcctgcatgacctcgtacagtcgccccagccggtagttgattttatagaacaggttttcttcttcaaccgtctgcttgggctgcatattttcggagagcatatcatccatctgaccacaaaaggcatcggagaaccggaccagcttccgacgaatcagcgccacaaagcagatgacgcagagcagcacaaaaagactgaacaggaacacacaccggacagcggttatattctgggtcagcagatgaacagcggtgcagactgcaccaaccgccagcagcaaaagcgttcccaaaaggacgcaggctttgttgatggagagttttcgcatattcatttcgatgcccctccgatccacatatagcccataccgtacaccgtcttgatgtactggcgtccatccgtttcaattttattccgcacccggctgatggccgcagtcagggcgtgttcatccacaaagttcccatcggcatcccacagcttttcaagcagcacctgcctggtcaaaacattctgcggatttttggtcaggattttcaacagccggtattccaacggagtgaacaccagcgccttaccggacagagaagcagtcatctccgagaaattgatggatagtgcgctatcctcataacaatccccgccgccagattgttttgccagccgccccagcaccacggacagctttttttgaaagacgctcataggaaatggcttggtcacatagtcctctgcgcccaactcatatcctttgagcatatcgctctccatatcatttgcggtcaggaagatcaccgccgtatccggccggcgctcttttacctcccggcagaaatcaaagccattcccatctggcaggtttacatccagcacgatcaggtcataatcctgcttagtcagaaagttgctagctgctgattttgtcaatacagagtccacgacatagcccgcagtatacaggttatagcacaaagtattattcaaaagccggtcatcctcgactactaaaattcgcaattgtatcacactccttcattcttagtgtagcatccaaatgtcacagaaatctcacgagaggattatttttttgtatttttgaaacgacggtctgccggtttctccgcatccttgggaatcagccaaatggtagccatcttcacagcaccggggatacgcccaccggcacacagataattgatctgccttggggtaacaccccatttttcacttgcttctttcagcgtcatataatccatatagtttccctccaatatggtttattatatttcctttgctcgaagaatacaagcttgcaaatagggcgcaaagccctgtgccagaagcactatgtggccttgcgccctttgttattctatcctaaaaatactttgccagctgcttcagaccgcgccggatgctgtcacggacacggcttgggtctacaccctccgctgcggcgatctcactcacacgcatacccaggtaataccgggcatagatcctcttggcctgcttctctggcagagccatcacagcggcatagagctgctcccgcagctgcttttcctccagaagcatctccggtgtttgcggcttcaacagcaccgcattttcaatgccattctcgcaatccagagaatactgtgctttataacgatacatctttcgctcatacgcagcctccgcacgttcagctgctcgaatagtctccattactttctctgtcacatctacaaaaaagtctgttgtataaacatcaggataaagttcccgaaggttaattttcttcattatgtacctccatttcgattcacgggtgattgacgggtgaatcgaatgaaggcggagaccgacaccagcagacaaccgggtcatctccgaaaaaatggcaacaaaaaacgccagatttccgtgagggaaaactggcgcgccaagaacagccattattatactgaattacatggaacgataatgccgatgcaatgttatacttgcccggagaaggagcaatgcttttttttaactgatgtagatcatgtgagctttgaaaaagcaaacgagacacggcaaaataacctccaatcggctaccgtgtccctgcaagtcgtcatagaattgtgtaaacgcaaagaaacggcggctctgaaaatcaaagccgccgtttcaaatgggcgtgctcagacctcacggtctgggcgatttttctgtcaggggagtttttttacagcccctgtattaatactgattccatgttccgctgcaagtgtcattacagctttaatctcattaagttccattgaaatgtctaccacatctcttaccagcacacagataatggcatctctttcaatataatatcttaatcgttcaactgcttttttatctgtattaaaaattgtctcaacaactttcatgccggacttttttgcatatgcctcgatacggtcagctgtatcatttgcattattccttacaaatatcagacattgctttttttctctggaatcctgcatattgcctcctatctgccgtccctgatgttatgatagaacattgataccgtatcaagcaccagccctcttatatcactttcctgaacaggctctttgtacatcatctcataacactcttcaagttctccattaatatcctccacatagatatcatattcgctgagttttccaagtgtatcaataacggtctcatctgttgcaccaatcatatcctttgaaagtgttatgattgtattaacatcttcttccatatttaaaccgataatggcatatttcatcggaaatgaaactccttctgtagaagcaggctctgaaagcatagctacaatttcatagccattatcctgacaatacttttcaagcaactccggcacaaaatgatctgtagcctctaatcctgtttttgcataatatataattgctctttccatcttaaaatctccttataaataatattgatttgatactgtgcgcactttatctcctcacataagctgacttatctgtactctccacaccatcacacctaaacatttcttttctgtcggtgaccataaatcagtttgtgtgggaagataaaatactatcttcccggtttcttaaccatccccgtatcgggtaacatatcctttgccagccacaatcacttcgtagtttcctgcccatctggacttacgaaagtagccactctctgaaaatgcgttttgctgaaattcaggtgcacttattatctcattacctccggctgctaacccggtaggcacaaccctctgctcttatccttaaaggctcctgctgttacgtttctcataatcggctgcagctccgaggatagtcatcgcacgaaatgggattctgccaccctgtcatagacaaggcgatataagctcgtgggatatgcgtgtcctattctgttttcaatattcaacggttcttttctcagaacctgaacagagtataactgacaccacgcatcttctacagtaaccgacactcttttgaactaagagtaacactcccacctgttccaaatccttataaaaaaagccggactgcatcatcaaaaatgcaatccgacttttttattctgtcagaagtttcatattgtcaacggcatttaataccatattccggataaactgtacttccttctccttcagaccaaccagcagatcatcgacttctgcctttctttcacacccacacacaagataatccaacgttatatgaaacaattcagcaatactaatcagcgtatctatttttgctccatttacaccagcttcaattttccgcagagcatccactgacaatccaatctgctcggcaagctgctgtcttgtcattcttcttgccgcacgcaactgttttattctttctccactattaacaatatcgtagtacaccttccactcttttccggcaccttatatatttgcttaagctgtattcattgtaccgtaagcgaatcttttgtcagagtgactaaaccagctatttcaagtggaatattgtacaccttaataccaagaatataaatattcgcagattaaaaaaagagatatttccaaactctcattacattttggaaatatctctttacttaatatcctcatccggcacaaactccatgatgtcctctatcttacaatcaagtatggaacataatctgtttaggattaccgtttttacgaccatattctttcgcaatcgctgtaactgtgctttatctattccataatctttaattagtgcatactggctaatatttttcttcttgagtgtaatccataacctgtcatatactatcattacaaagacctcctccttgtattctacgcaagagtgtcctataatgatatggtgcgtgtatgcaccatactgtatgtatatgatagaatagaaaatagccataagctgcatagaaaacagctctcaaggttattatgtaatatagaacggattatctgttttacttttatggtattcaaccgggacaattcaagcacctgacaatttgcccgcagatacccttctcagaaaggattcacaacaacactatgaatgataaaagcacatactctgttgataaatatttggaaatcattgccgaaaaagaaggaatcacaaaagaagaagtccaacaggaaattgggcgggcagtttccattgctttaaaaagccctgatccacaaatgcaacgcttctggacagactttccatgtgaaaatgaaactcccaccattgaagaaatcatataccatctcgctgaaaaatttgcaaaagagtcatagacaaaggacaggataactacccgtctattcactcagataatcttcctgtcctcttaatatttgttcaatcatatgtaatgcaaattctatttctctttcgtcgcaccgattcatcataaatgcaaaacgctcaatgtgcttcttagggtgctgctggctcatcagaaccataggcgatgactccaatgcatgaacaatattcaaatatgtatcaagactcattgcccttctgccattttcaacacttttgatagtatccaatgatacatctgcccgttctgcaagctctgcctgtgtaattccaagccttctgcgttcttttctgatattctctgcaataatttcgtatatgtgctctcttttccccatagccccatcatcctttctgacttatcgcattatatcagaaattattatgggttttggtaaactgtaatcctttgacattttcgtgtaatactttgcagatattgctattatttagtgcttcatgcaatatactagtccatctttttcagtcctctcaacatatctttaaattctgcattgtttattaccaaatcatcatactttccagtaccaacaacagctccatctttcaacataacaatctgatccacatcttgaagtatctcttgtttatgagttataataataaccgtcttttcttttagtctcgtatgaagaagtccattgatctgatgttctgaatacacatccgtattagaagtcacctcatcaaaaattataatcggtttatcatgcacaagagctctggcgagagcaattttctgtttctgtcctccagaaagcatcgctccattttgtcctactacataatccaaagatacctcctttaaaaaatcttctaatccactgtccttgcaagcagtttctatcacttcatcacttacttttttgtaaatacatatgttattgcggattgtatcattaaaaagatatatttgctggctgactaccgaaatcatatttctatatgactctaatgtaatctcgaaaatgtttactcctttcaattttatctgtcccgcagttggttcatacattcttgtgagcaaattgataattgttgattttcccgaaccgttctttcctatcagtacagtcttacttcctttaggaatttctatattgacatctgtaagaattggtttgtctgtttcatacgaaaaaaaaacttcttccaatttcaaatttccaaactctggctttataagttttcccttatccgtttcctcttgcagattcataaactcgtagtatctcttggtagacggtataatacctgatagcaaatagccaatatttaaaattgctgatattggacccgtcacataagcactatatgtaataaacgcaaaaacgcttccaaccgataattggaatttaaacaccaaattagctccaataatatatatcactgtcactaatatttgtacaagtgtggtatctataatattgttccattgactaagtatatttagtttcttttgtctttcaactactttcgactgcttttgagaaaactctgcatgtttataatttaatattccaaaaagttttacttctctcacaccaccaattgtgtcaccaaaccatcttgcgtacttttgactatcattgataaaatcatccatcactttttttcgttgctttgcaaattttttcataactacatattttatcggaataaacagcaaaactaaaattgtcattcgccagttcaaaataaacaacccaatgactcctccagtcatactgaatgcttgtgtaacaacaaaaaacacaccttcatcagcaatagatgtcatattaccgatgtcgacatttatattatttaatatttcagcgtagttcttgttattgaaataacttgctttcattttcataagatgtgaaaaagcctgttcagaaagagaatattgtatttttgctgaaatattgattctattcttctccttgattatatcaattacagaaatcacaagataaaccatcaaagaacaaagcactaattttattaacagttccttattgccaccaataaagccatcatccattattcttctgcttaacaatggtacacataaattcaaaactgttgagatcagcaggcacccaaatataattgatattatttttgtatagtcctttagaagtgcaagcaattttcgcactgcttctctattgctcatccgtaacctccataaaaagttttaatactttctgatacaataagtgtattgatctgctctcaagacaatttattgtttctctaacctccatattaccatcacaatagatatcgattttcaccattccagctacagttttcaccacgataatcatatccacagctttttccaaaacatttatgtcatattccttcttgtcatcaattcccatcaacaaagcatccgactggcaataataagtctgccaatataaaaaattatatacatcttctctgtttgatttattacacaattcctctggcagaaattccaaatcatataacacactctctaccttactgcttacagtaaacatattatacccgtcttttgcaaaatattttcttagttcactcaaccaataaatactatcctgattttctgaaaatttgcaaatgataacaggaatacctatttccgcttcccttttcctacttccaacaatctgcttcactctctgttttctgcaccaaaaatatctatcaagtgtcctatactctatcggttcttgacccagatataccatatgcttatccaacttacaatattttttaaattcttctttattgtttacaataatagtatcaatcaccgataaacatccttctaattctccactcacttcttcgaaataatattcttccctactttgttcacatcgctttgatacccatgcaatttctatccaatctggataatatacaaaatcttcttttgatgaaagttctctccgtattgtataaacattactgtaagattttttttcaaaatattttcctatcatagcagtcacatatggagcagcgtagctattgctattacccactttaaaaggatttcctctcaacactatttcatggtctgatggaacaataaaatctactcctatatgtttctgtaaattaatatctatcttaaaaacatcaccagccgctataccaataacattggaaaacgatgctggataagttttgtatccgtcattagctgatgcagccacaataaccattcctctatttgcataatgattaatcacatcccgaatacttgttctgtcttgaaaatgtgttaccccaagactaagattcacaagaaaaatattattttgataacaccaatccaacgctatttttaatttatctacctttcctattccatcatcattcaaaattttcacactgcttaacatacactcagaaaaattattttctattatcatggcacatattgtaccatgtataaatcccaaaagatccatatgttcattatcaatgacacaacaatttgtatcgtcaatatataccctatattccaaaggctgtcttaaaactttctctacaactccattatcaatgactgctatttttactttatccaaaacaatcccaccttcagacaacattttctactttttcctgaaccgcagcgacaatgttatctaaaaaatcaaatcttctttccaatatatctttatcattaaatgtaatatgaaatgcactttgtaacccaaaaaatataaccaataaatctctcggttttaatccaattcttggatctaacaaactatattgataatcaacttcatccgtaaatttgatatttaactctgtttcaattatgtttataattttttctcttaaagaattttccatctctaaattatctcctctcctagaattgttcgcaccttccgtattgctgcaatctgctcagcacaaaatcatatatatttctttgttctatatcactatttgaaaatactgtgtatttttctgataaattttgtatttcacttgaatatgcatacgaaagtttctccctatacatagaagcagataacgaaacataccttgatacaaaataagcacttgcatcaatattatacttaaaacgacacagtttcccaaattcatcataaaaatcatcattataatttccattcatcaaagctattattgaaatatccggagaaaatgcactgtacagttctgttgcataaatgccataattaaacggatgccttgatgatagagaaagcaacggatcatcaatgccaataattattacatccggcttatctcttttttctatttctttcaaaaaattgttaaaataatgtattctatgtacttctggtaaatctctgcaaaacagtacatcgccaagtgaataagcccccattagctcatttaattcccctgttccaataagaaccaccttataaccgtcctttttgaaattatttaacaaatttagctgtatctgatatttttgagctaccggaaccactcctgccaccgatacaatcggtgtttcaataatctgctgtaccaaagaatattttaaatttctataatctatcattccattttcaaattgaatatcatcctgcattttgcatcgcacattattcagactgcatatctctttaaccctttttctaaatgtaacttgaactcccatcagccaaatttcaatgccttttttgcagtatttttctataactcctaatgccacatcacaatctaaaacttctacattgctagttactaaaagcacatctatattactatttgtatccaagtcatcccattttatttcatgatattcccttgcatatgtgcttttgtctttaatttcttcttcacttaaaatgttaccgttatgatttataaacaggcaaaacctatatttatcaaacaattccttatatcttataactggaacaaaagactcatcaaacggatatatccctacatttactttactcatttcttctcctttcataaggtacgacagccatatttttttaatgttatatagtttttaatattctcttctattgaaaatctgcttgtcttacaaaaagaaagcctttttcctttatctaactttccattattttctgcttttccacagcataactcacacatcttataacaccaacaccttttacactcatcttctgaaatttttgcaacattgagcagatttttagcattctttatattaaaaccttcctgaatacttccaatacataaaatgtctgatgtttcatttaccctttcacaagggaacatcctgccatccacattcacaaacaacctctgtattcccggtaagcattgtccacctggacaatcgtaacagctcttatgcttattataaacatttctttcaaccatctgattatgtaatgcagatatatgaaaattatatagtgaataatcatagccttttaacaaatttgtacaactatttaaataaactttaaaaacttcatagctagaatttgcataaaattccggcggcacatcatcctgctccaattcttttaagttgtttacatcaacatagtttcctaatacacctatttcttttactaaatcatatgacataaaaaattcacttgtacaagaaacatcctgtttcaagtcaataacagcattaaaagatatttttttaataaaggcaggacaaatctcctttaccatatccaacttctccataaccgtttcatatgttcccctgttactccctgcaaatattctgttcttattttgaatgttcgcaggtccatctaagctaatggtcagattaaaatcatgtgcagctaaaaataatacactttcttctgtaagtaatgttgcattactcgtcatattaaaagacaactttttacctgcaaatatttcttccgcatacgcaacacactgtttaatcaactcatattctaacagaggttctcctccgtaaaatcctattgttacagaatcactgtttaacgaatgatcatagaaaaattttattgctgctattgctgtttcgacactcatacgcttattcatatgtgttctattaacataactgcctgaatatacacaatatttacaccgcaaattacagttttgtgttacttgcaaagtcatcatattcaaattggttttataaaattcttcaattctatccgtttccggatgcctaaaaatgatgttttcatttttgtcacaaagaaatcctttttgcatcaacaaatcaatatcacttttgcattcctcacttaatgcactatactctttcccaatttgttcccttgttattgatgttttcgaaagcaaatttttcaaaaagtcatacatctcatccgaaatatgaattattccatttgtgtttacatcatagaaatatttttcattatatacttctatcaaatggatatatggtatatgatcaatcatatattttcctccttttaaaaaaggcagcctgactaaaagtcctatcagactgcccatagcatttaaacatatctcaaaagagtagttcaaacactgtttgtagcttctgaacctaactcaaaagagtcataggtccgaatgacttgttgtacagattgttgtaagtcacattttttgtgagctgtatccctgtagcattgggaattgtattacaattattacaagatgtacacaggcataaattacaattacaagcacatgcaaaagcaactaatgtaccttcattgaatccgccttttttaccaagtttcttcatactcataatctttcacctcctttcctcaatctttaactataactattgaaattgcttccaatattaatagtcgatgaattataattaacggctttattgatagttttagtctttccttcaacaatatctataccttcattatcagaaacactggtatttttttctttttctgcctgtctctttgcccgttttgactcaaacttttcttcctctgcttttttagcagctcttttctcttttactttttcctctttttctctgttctcttttgcttttcgttcagcattctctttcgctattttcccatctggatcatttgtaccagatactgtctctataatatttccgtttgcatcaatcatataactctgatttgtcacagtgcccaaacatccattaatcgtatcttttgtacaatccggaatggctgctaagttttcctccaaatactttgctttttccggatcattcatgcacttttgtaaaaatgcacttgaaacagataccgttgtcggaataccctgcattgaagtcagccctatattcatataatggtattttccttgcaagtattttgaataatcatttacattactataccctgtcttaatctgctctgtttttgtcacaccgggacgtgatgtttttaattcaactgtacttgttgtcacgttgccatcttttgtatttgtactatccttttcactatctgttttttttacagtattcttataatttgaagcataatacgatgtgtaactgctgttattgatacccgtaattgccataatcctacctccctgttattaaaacttaaaataatttctattatattgaacgacttggatatttaatttccgttgatgtaaattcatcttctgccgaaacattgatatgcccactgctgtcaatagcatactctttaccataaacggaaaacgtatctccttctttatatccaatttctatccagtttatatcatttaactgttttatctttgcgtcaacatttatggtttttcctgattcctgcaataaataagtgtgttttcctgctcccgcatctatagaaaagaatcccggagaaatcccgactttctcacagactgacagtacttcctcgttactgtagagatacccccacacactctttccctgtgccagatcagataaaatattaccgactgggacaattatttatgagattatttgctggattgctataagaatctgatgtaacgatctctcaaaaaacagttaatttaaaagtcgactgtttttgagaggtcgttttgttatatcgaatgatttgtacagaatttccgtttaggtgaaaaaaataaattttgttgaggttgaattgagattgataaaaaacaatggtgcctgacacaataaatcacggagaggccgttgaaactgccggaacctgtctttcactgcgtggacatatttcatcatcagccggataatatcgatgtgccttccagaatccctgcgcatgaagaactttctggctgtttttaatgctgaagaaaagtcaagttcatagagatacttgttgctgccatcccgtttctttttcaggttttcttctgccgcttcgtttgcgataaaaatgccgaaattgcattggaacaattggtgcctgacacaataaacttgcaataggctgcttttttctgttgagcaagaagtatcttttaattcatatttaggtggtttgtcaatagcaataatatttaatgcataatctgatttaagagtgaatttcaaattttagattttcaataatcatgggataaaaataacagggaggattatagttttcggaataaagccgatatataatattagaaacaataaataataaagaacggattcagagaaggaggacaaaggatatgtcaatgaatgtgaatacaacgggtactgtttatggaagttatcagaatacctacaaggcaggtacagtagataagaaaaaagaaacagcgaaaacaacagaaaatgataaggtcaagaaacatgtgacagaaagtatagccgaaaaaaatctaagtaaagaggcacaaaaaatgcttaaagatatgcgtggctcaagaacagatatggactttatggttgcagattttgaaaatggtgataatgctaaagatattttagcacaaagtgataaagagtttacggttattttctcaaaggaagaaatggagaagatggcatccgatcccaaatattatgctgaaaagatgcatagtattgaaggtgctttgcgtatgtcggatgaaatcaatgctcagtttggatttgaaagagcatttggtaagacaaacggaatagaaaacagtgcagatactgatacaaaaataacaaagtttggtatttcttttaatagtgatggaactacaacattctttgctcaattagaaaaaacatcagctagtcagaaagaatatcttgaaaaaattcaggaaaagaaagctgcggagaagaaagaggcgaagaaaaaggaacaattaaagcaaattgaagtaaaaaaagctactgttcaagcaaattcaaaagatgaacttttggataaaattaaaaatattgaatggaattctatcaaaccagaggataataaaatcggtggaagatttgatttttcaatttagtatatttagatggggatgattacataaagtatggaggtagattcattatgagaaaacgttttttttctattattgtatgtgttgtcatgctttttacaatgaatgtcacagcttttgcggcagaaactcaggaaaattattcggagacggagaaaacaatgacatttgaaataactccgacagcattaacttctggatcatcacgacattctgttggaatgttaaattccttttttggaacaaatgatacagtggcaacttccgctcttggttcttttacaatcagcagcacatctgttccgtcaggctccacaatcagtaaaatagtggttacatccacaaaaagtagtggaagtagtggaaacatcgaattatttgttgctaaagatgaggataatggagatggcacatttgacagatatacagacagcaaaagttggaatagttctcttacttttgcagattttggcaattataatttaagccctgttggaaattattatgttcaatttgaatatacaaggtattcaacgggaactgttgcagcagcaacattaaaaaatatttatgtcacagtatactatcattaaaattttataatccccattctaaacaagcaaagatgttgttattcagttagcagcatctttgcttttaattgtataattgatatgactattgagttagaatgacattgatagcgatagaaagctatatattacagaagcagactttgataaaaaagcatttgagagattatataaattgaatattatataatcagaggtatatagaacatgcacagagacactatatttcaatatgaaacaatggtgcctgacacaataaaaacgcatagccaaacttcgctcggtataactgcctgattgtgtcgaaattcgtattttatcaattatatctgataaaactggatttgcggtattgaaaatcagttatagccgtggtaccatatagacagtttcagaagggaggctggtctacatgattaaacgagaaatttatatgagccgtatccgtccttttatcggaaatgagctgataaaggttctgacagggattcgccgtagtggaaaatctgtcatgctgagcctgatccaagaggaacttgcccaaaacggggtccaaccagaacagtttatttccctgaattttgagaacatgagcaatgcacacctttgtacggctgttgcattgcatgatgaaatccttcgcagaacaaaagaaatcagcggcaaggtttatctgttcttcgacgaaatccaagaggtggctgattgggaaaaatgtatcaactctttccgggtggagctggattgtgatatatacattaccggttccaacgccaagctgctttccggtgagcttgccacttatcttgccggacggtatgtggagttcgtgatttacccgttttcattcagagagtttatggagctgtatcacaccgtttacgaaggtgcagacgaaagacaatgctttacaaaatatctgacgctgggaggaatgccctatttgagcaaccttcgctacgacgatgccgccagtcgtcagtatttgcgggacttgttcaactccgtagagctgaaagatattatcaagcgaaacaatatccgtgatgtggatatgctggagagaattattgcttatataacttccaacatcggcactaccttttcttccacagccatttccaagtatctgaaaagtgaagggcgctccgtttcaccagaaacggtactgaactacatcaaagcctgcacggacgcattcctgttttatcaggtgaagcgccaagacctccagggaaagaaaatcctgaccgtcaacgagaaatactatgttgcagatcatggtgtccgggaagccgtgtacggtggcaacatgaaggacattaaccttgtccttgaaaatgttgtctacatggagctgctgcgccgtggttattctgtgactgttgggaaagtctctgacaaggagattgacttcgtatgtgaagatcatgggaaaaagctgtatgttcaggtttcctatctacttgcctcggaggaaaccatccagcgtgagtttggggcgtttgccggtgttcgtgacaatttcccgaaatacgttgtaacgatggacgaactggatatgagccgagatggaatcaaacaccgcaatattcgtgacttcctgctggcagaggaatggaactgaaatgttcttctttcaccagaagatatgcagaagttcttccaatgccgagaatgaaaaaacaatggtgcctgacacaataaatattatgatatgtctgtatttaaccgctgtatagaaaccgggaatgttctcttaatactggaatgttggcaggatgtccacccggcgcttgtcagtatcccagtgaaatgggaatacagctcgccgtatggacttttgtatgctctgaatccgccggatgatgttatgcagtttgaaaacaatggtgcctgacacaataaatattctttccggaattcttgcagagatgggagacatttcgagatttgatgatgttaaggaaatacaaaaattaagcggattaggtcttgtagcatgtagctcaggaaagcataagggagagaccaaaatcagtcacagaggacgcaaacgactcagatactggttattccaggcggcaaagtcagcagtggctcatgcggaggaagttaaagaactccatgtgtactacacgacacgccctgacaatccgctgaaaaagatgcagtcactgattgtgatagcctgcaagcttttgagaatcgtttatacgattctgaagaagggaacggtctatgatccgaagaagatgctgatggacatcaggcggccggaaaagaaggaagcgattgcagcataagacaatcgacagcattatttattccagagccttgccgggttgcggatgattccgaaatcgggcagggttctggaaagaaacccgataacgatggagtgcaacaagcactgcatcagcacaatgaccagcaggtaacgaaacaagggaagcgtccacggaatatccgtaccctgcggaaagggcaggtcagtaaaatcaaaatataaacaagagctgtagcctgcagtagttcactccgtagggcaatgaccctgttagaaagcttagcgggcactcggtgtatgagcaggtgggacgaaggaagttggtacacgataccattagacacggaaggttcaccatcatagttaacagaggatttatagcctttataaagcaaaacaaagggacgctttataaactgcaccctcttctaactattcagtacaagatacaatgactgtcatacacttgtggctctgttttatgaggtaaatatttaaagaaaagcctgaaaaatcagtgatttagggcttgacattataggagacttcctgtataataaaaagggaactttgacatatcttttcggtttacgaaaaagatcacagtcgtcaagtccgaaaaagatgcctataagcatgtgcttaaggcgatgaaaaagcgtgattacagcactagctattgtgcggacggagcggtgtattacgagacatttgtactcgcattgcagcatcatccggagtacaattatagtctggtcatctggaagagtaccgatggaacatttgattaccgggcaggtaatgacctgagtgcggcgcagatcacgggtaaaataaaacaggcgaatgcaaaggcgaacgcgattattccctggattatcagggacggaatgacgcgcaaacagaagctgcgtgcgatccacaattatctcgtgaaaaactgtgtctacgatgagaacgcgcgcagatacggatatgatgatgcctataccgcatatggttgtctgattgagaaaaaggcggtatgtcagggctatgcaggtgtttttaacctgcttgccgcaaaagccggcatctgttcgatcgccgttccgggtgaagccggtggcggatcacatgcgtggaattatgtgaaagacggaagcagctaccgctatattgatgtgacctgggatgatccggtgcaggatcagggtgcgaaggctgccgtgaaatagacttatttttacttgacacaggcacaatttgaactgacccacacatgggataaggtagagaatgctttatagagtcggcggaaatttatttacgggaatacataacagatgaaagggaggatactacttatgaaaaaacagcttacagcacttgttttatgtatttgtatggtattgtcggtgctgccattttcaagtacacaggcagctgcagaggagacgagcagtgttggcacaagcaatattagcatcggagactatatcaggctgggaaactataacgggcagccaatcttatggcgctgcgtcgatgttgatgagatgggaccgctcatgctctccgatcaggtgctggcaacgatggcttatgatgccaaaacaagtgaaaacagcgctacgcgttcgcacagccgtaacctaaagcgtgggacatatggctcaaatcaatggcgtgacagcaatatgcgttcctggctgaattccaaggcggaagccgggaaggtagaatggctttgcggaaaccctccaaagagtggctttgtaggagagaatccatatgaccaggcagcaggctttttaaacggctttaaggaggacgagatcgcagcgattaaaacggtaacccagcgttcgatcgtatcccatccggaatataatgcgggaatgatcgaaggccagggggcagatctgccttatgacacaaatatagaagcagccgctaacggatttgatcaggcctattatgagaacgttacggataaagtattcttaatggatgtaaagcagataaacaaagtctatcaaaataacagccagcttggagacagttatcatattgcttataagggtggcgtgaggtggccttactggctgcggactccggtgacggattgcaaccacgatatgcgctatgtggagacggatggaagaatagacagaaacgctccgtatttaggcttttatggtgtccgtccggcgttttatcttgatacgcaatattatcaggtgactggtggagacggtacagctgattccccttaccgcggtgcagccgtaaataaaccggaggagaactttacagtttccggagatggaccaacaccggggcaggagtgggatgtttcgcttgacaagagtatacagttatatcttggaccgaattattccaagagcaagaaatacgaatctgccacgatacctatccaggtcatccagaagacgcgcagcgataatgagaatatggttgtcgtcatctgcggtgaaggttacacaaaaggcgagcagcaaaaatttgttgcagctgccaaacggttatgggaaggcgcgatgcagtatgagccatataagacgtacaaggatcgcttcaatgtatatgcattatgtacggcatcggataaaacgtacagtgccattgatggatatgacagtacatttttcgatgtatggggaaagaatatatccgtgaatggaagtcagtggaagaaccatatttttgaacggtgtatcggaccggcgtttatcgagaaagtgcatgatgcccatattccgcagcaggcagatccgaatgtagattgggattttgaaaagtataaatatgtacatgactacatcagccagttcgtacttctggtcaattctgcaaatgattttggcggggcattcaacgatcttgattacggattccattatattgtcagccctgcatacagccagcgtgcagtcgaaacgcttacgcatgagcttggtcatggtctgttatggcttggagacgagtacaacagcggatcttttatgggagaagcgtctgaaaaaacttcgctaaacagaacggggatcagtgatcctgaacaggtaaaatggagacagctgcttggcttccggaagacatacagtgttcctcatacagattatgatacggataagatttataattccagccgtgaatgtatgatgcgccagacctggaatggtttctgcgaggtatgtaagctgcagggaaataagcggatgcgccagctggtcacagagggtccggatctgtatgtggcagaaccggaagtgacaaagcgcacagatgcatatacgaagctttcagattttagtgatgcaaccggttggggttatacaaaatttgacgcagacaaaaagacacgccttttgacaggggcagataaaattactttccaaccgacagagatgaaggggcagaagattgagctgcgtacaatcgtgcagaacctttccgatacaaagctcagtcaggtgacattacaggtatgggtaaaccatgctgacggaaccattgctactgctgatggtcagcctgtagcagcgtcagaaacgttcaagattccgctttggacggaaaagggcaatttccgcccgaagggaacgttggaatatcatggaagcgattttaattccggtttgaaaaattgttccctcttatataccatcccgtccaatgcagatctgcgaaccggtgacacggtcggatatgcagtgagggatgagcagggaactgttcttgcttacgaaggaacgcttccaaacaaaggtcaggatatcttgccggcaccggagcctgcaaagagttatacagttactttttgttataatgacggaagagaaaatacaacaaaaacgaccggaatcaatggaaaactcggtgatcttccggcaccggcccgtgaaggatatgtgtttgacggatggtatacgacaggtggtgagaaagttgatttgacaagagtatatagcagcaatacggtgttgtatgcaagatggagtgaatatatcgcaccgtcaccgaatgttaagaaagctccggtcattctgctggcgacaagcccggatacagtgaccgaaggagaacaggtcatgttaagtgtcagcgaaacctcaggatttggtgtggatttaagcggagtaacttacacggcagatccttcgctgccgatatccggcacaggggaggctcagacgatccggctcgatcaagctggtacttatacatttactgctcattattccggtgataatgagaaatatcttgcggccgacagtaatcgtgttaccgtaaccgtaacgaaaaaagcggatgtcagcggaggaacaacgtcaggaggtggatcatcgtcaggaggcggttccacggcaggaggcggatcttcagcaggaggcggatcttcagcagggggcggatcctcgtcaggaggcggtgcagcagcaggaggtgccaccgcgggaggcggcgcagctaacggaaatgcatctgcaacaactacgccggacatcaaggattcggatggaacgactgttgccatagtgaacggtaaaaaaggaatgatcacagcagaagtgcagcttagtgaaaaggcgatcgcaaatgctgaaaaatcaggtgaagcagttaaacttccggttgaagtaaaggcaggtaaaaatataaaagctgcatccactgtgaccatcaatctaccggagggtgcagggaaaacgaaagtgaagattccggtaaaaaatatgaccgtaggtacagtcgcagtgcttgtcaatgccgatggcactgagaaaattgtgaagaaatcagtggctgcaaaagatggagttcagctgatcgtggacgaagacactacagtgaagctcgtagataaggcgaaaaactttaaggatacaaaaaaacattgggcgaaggattccattgattttgtaagtgcacgcgggctgatgaatggaaagagcagtacggcttttgcaccggaagcaaaaattacccgggcacggctatggacgattctcgcacgatgggaagacgtagatctgacaggtggaaagaagtggtacagcaaagcacgtgcatgggctaaaaaccagggaatttcggatggcagcagaccaaatgctgcgataacgagagccgaggcgatcacaatgctatggcgtgcgcaaggaaaaccggcagcagagcaagagacagcttttaaagatgtttcttctgatgaatactacgcacaggcagtggcgtgggccaaagagaagggtatcgcacaagcgaatagcaaaggacgattcaatccggatgctgcctgtacaagagcggaaatagccgcattcctgtatcggatgtcgttgagtgaataaacggtttacatgtaccatctggtataaagatagcaggaaggagatacctgatttgaaaagaactgcaaaaatcattttgacaggagtctgcctcggcttgattttacattgatttaatcaaaaaagaaaaatggacgatacagagaaatctgtatcgtttatttttcgtcttttttaatttataggaaagttctaactttgggatagctagatatgaaaagggcccgcaatttagcgggcacgacaagtaaacgataggttttagaagatatagaagccttcagctccaggaaagtcttcaccaaactcatcgtcttcatttaagaagtaatccatatcaagcaaatcatcctcactcatgtggcggatgtcatcagcagtcatgccttcaggtggattctgtatgtacttgtttctgatttcatctgaacgttttgacatagtattttcctccgttttttacattctatcacagaggaaggtgtgatgtatatatttatgctgatgaagtatatgagagcctgcccatagcgttactgttcagaccattgtaaaaactgacgaaatttaaaaaaatatatttgtggataaactcaagcaggatggaaagtttcgttaacgacttccgaatcctgctttttcttttgaaattataaacagtacctgcatattttcctgcttttacatggctggaatacggatttccagtcctgcttctttcatttttcttccggttatccaccgtcattctgccagtcccggaattcgtccgatttcccattcgtccctgtttttgctgtacttatcctatacttaaggaggcacaaatgaacgcagatgataaaagcaaactcatatcgacacactccttctgatattttaccttttctgcaccaagtacgattttttgcacgaagtaagactttttatgaattgaggaataactcagcaataaatttatttccatcacttttcaatattaaatttccatcatatttttttacactgctctgaacattcagcagtcctattccaccgccttttcctttcgctgataccggaaaaccatttttccactttacctccccgcagttattttcgatgctggcagctatcattttatggtatgagccaatcttaatcgaaatatatttcccgccttcaagcttctctgcagcctcaatcgcattatccaataaatttccaaaaatagttgtaatgtcgattggtgcaaggaaattcagattcacattatccacctttatggttactgaaatacctttttccttcataacggattctttatcggtaagaagaatgtttaatattggattttctgtgtattgaaccggaatgagcggctttaacagttctctgatttccgctgcatattctcctgccgtattcccctgctctgcaccatataatccttcgattgctttaatatgcttatttacatcatgtaatatgtggacggtttgatcatatttttttgtctgcgtcaaatagtattcgtattgtacctttgcctgttgctctaaagcgatgagctgcttttcataatagttcttttcatctgccatttttacaaaatataaaaggtataaatctgccagaacaatacatcccatgttgactgcacacaaataattttcttctccatttttaaaattctctacaattacactcatgttaatcagactgtacaggagtatcattccatggattcaaatttcaggaggtcgtatataatgaaaccatgtcaatctttccaatgtccagtagaagcaacccttcagcttataggtggtaaatataagtcacttatcctatggcatctcattggaaaaacacttagatttaatgaattaggaaagctcattaaatctgcaactcccaaaatgcttacccagcaacttagagaattagaaaatgacggattaatcaacagggtcgtttatcctatagttcctcccaaaaccgaatactcattaacaccttttggtgaaagcatcattcctgttttggaagctatgtgtaattggggaaattcctacttagaaggaactgctacatgtgtcaattcttgttcttctatataaatatcgtctttctacctaattataccttcattgtctttgccaatgatgtaagtagcgcagccatctccggatttcccaacactttcatcaacaactctgcatccactccatccggcaccgtaatcgtactgttgccttcatcctgcgctttcatctgcggattgagattttccttattataaaaggcattctccataagctccgcattcttccttcggtcttcatcaaggatatgaccatacacttccgttaccatatctgcctgagcatggccggaatctccctggactgctttaatatctcctccactgagtttcaacttgtaggtgacactggtatgacgcaaactgtgaaacactacatcaggcagtcccagttcatctatgatgtcctgcatcttcgtcctcagatagctgtcccctataggaagtccgaaagttgtagccataaccagattataattctgatactcatttcccagtgcttcaatgatttcttcctgatcctttttcagatcgatcagacattgtgccacagatttcggaatgaacacttttcgcttgctgctatccgtctttggtgattttaacacccggactgttttattatttttcttctggcttggaaatatcatgataatttcttttgaattgagtgcttctattgcatcctttgatactctctctacctgtttattgatgatgacataggctttgttatctgcaatcgcctcttccgaaatatccatatcatcccaggtcagtcccagaagttcaccgatacgaagtgttgccgtaaatgcaagatgaaatgctattttgagcattttgttatcacaggcttccaatgcctgcataagcatctctgctgtccagatctcacgctcctgcttctttgcttttggaacggttgcatccacagccgggttcttttccatcatatcccactttaccgcctggcggaaacagctccttaataccttatgtatctcatttactgtactttccgtgattgttcctgtaccatccggattctttgtactctttaccgccggcattttaagaagatccttataatacttctccataaaatgtgtattgatgcttgcaagcttggtatctccgattgtgggaagaatgtaattatttatcagagccacattaccagagtaagtggaaacaccccacttgtcatgtccatatatctgcacatattcttcaatcagttctttcaatgttgcacacttttgaacctcaaattttccgatagactgcttgtactcaatttcttttttccgtttatctgcttctttctgcgtagcaaatgtttcagatgttgtatgttcttctccattctcatccaggattttatataccacagagtatgtctttccccggtgcctgataaatgccatgttatatcactccttccctgtgctcattcaaccagttcaggaactgctgcctgtgaaccctcagaacctttccggctccgacacactggaattctcctgactgcatccatttggtaactgtcgatacactcactccggccagctccgctgcctcctgcctggatatatattcttttatctccaaggatactgtatctttttcctgttcatccccatcatccaggatgtaatatacattctgagcattaaggaatagctgaaaactctttcttgtgatccaccttttattattgcagatggtggaatccagaagtcttccaatttcttcgctccttgcgatttttgccaatttttcccgtgaaatcccaagcagatccgctgcatcctgcaaacagatgtaatctttctccagttcctctgctgttggaatatatgtggccttgctgtatatatcctgatctgcataccatttttcaaatatatcaaccggaatgcgtctcacaaaatccactgtaatatactccagcttttcatttttccagatatcatacaaatcgcagtcatgtattcccagaatatttgcagcttccttaaatgaataagatttttctcttaactcttttcccggttcttcgccgtctacttttttatacttcacctgattggcataccacttctcgaaactgacaagatcaatccgcatcatcccaccaatcacttccgtcttaaaaaaatttttatgaaccagccagtaactgtctgtcttttttagtcctagcagctttcgcatttcaggcacagacatggtactacgccgggtcagcttctgttcggcacctcgttgctgattctgtttccttatctctgtcaaatccttcgcttcactcatactgcggcctccttctcacccactataacatgtatgcctgcatatcatttagaaggtaaattatatggtttcggatttctgatccagccattcgtcaaaactcttttttgaaatacgatacttgtttccaatctggatccagcggaattcatttttcttcaacagctcatatacagtcggtctgctgattccaagcatttcctgtacttcctttacggtatagcatcttttttctgcaatattctctgctgtcattcccattatgcaatccctcccggctgtccatccatgaatctctttacctgctttttcatacgaacttttattttctgcatctgctgtctcgctgattcatatgtaattccctgatcctctgcaatatccgaaattgtcttttctttctgcagatacttggtaaatgtctccttttctgtacccagaatcccaagctgactgttaaacaggttatagtctttcctcatatccctgagaatgtatgcatccctgatatatacttctgcctggtccactccgtccagtacgttacctgaaaaatcacagttgatcagtgcttcccttgtaataacattgttgattgcttttcttgcggtgggatcactggtcattcctccggtctggactcttactccaagatctccagctgactgccggtggctgctttccttttcacattcgatcatgtaacgaagcccgtctgtatagccgtccacgatgccaatgaattttgtatagtttttgataatgatatctatgcgcttctctgatgtagctcctgtatatactctgataaggttcttttctgtcattgctgtactccttttatttctgcatgtcatgagctttcgtacgtttactcttctttacagatattattgtagataaccacggagtaaaaatcgttccccaaacaatagacaaaagtctattcagaatgtacttttatccaagaagtgccagtgcctgaatctgtttcagtgcaacttctctcatctggtcatttttcagctccagcagcgcatccattattctggcctccagtgcctctgcctttttcccttccagcagatatgatccactgcaattcagggcttttgctatttccagaacaatgctgcttttaatgtctatatggtcattctcatatgctgatatcgtagctttcttagtgcacaggatttctgccagctgctcctgcgacattcctgctgcttttctcatttccctgattcttgttcccattgtattttctgcatatgtatttctcattcttttctccgtttccggagcccaaacggaaatacaacatgtcttatgatggaacagaaaaagagcctgcaaaacgcattaaaataaaacgatctctcgttatatttccgttttgcaggctccttatagtcttctgctatattcagctcgtttacaaactcttgcgcagtgggatcatctttaaggattctcggcattaccgaaatcatggttccggctcctctgtccagtctgatggtccgcccactggctcattttattcagttatctattactcgtgcagtattttcatactgcttatattattcaaacctgattttttctgcgatcccggattgtcttaagttcccctgatttcagatccgcaatcgtaaccgtccggcatttcggacaaatgatattcaatgatattacttctttacatgttgccaaaaactttccgcagcctgaacaatgaatcattctgtgttcattatctcgtttatcatttctcattttcatcctaatagtcgggtttttcactactcccctataaatattacgattcccccgtctattctcctttctctgtgttgtacaatatcctgagtacatatctggccattctctcaaaaaaatcgcgtttttccttccagggcatatttacaacatatctgtctatgtcaatctgctctctctttccggttactatgtatcgcacatcaaaatgaaaagactcttccagtattgacagtttctcacatgaaattgcagaatctccatattcgtatctctgatactgctttgtgcatataccaagagcatccgcaacatcatcctgagacagtgcattctcttttcgtatctttctcagacgtttacccatattcttttgatattcctggcatttatcgttatcgttcgacatattactccttccatttcatccataatagaatactattttcttctataaatcagaaccgagtaatatgtggaagattttggacattttagcgtgattttttccagataaaaccagacttccaacacatatcagtatctttattttattttcataaaggacagattatggggatattttcctgtattctgtactttttctgcatgttattgctatattgctcttttccgctgccttaacgcctccatatccgtagagtatctgctggctttttcctgatcaggttcctttccacggcagttctcaaatatcttcatataaatttcatccaccacccctacgatttctttcttgcatctcacacatgtaatctcaacactgcaattccctgccaccttaaacaactgctttccgcaggacgggcagctcacatatctcatcttaactctctcagtcatcatcaaagtcctcctgacattgtacaatttacgtaccattcaacggataagggaaatgaaaaccattgatgattgtatactctggataaatgagttccgatgtgccgaagtccgcaccattcatcctgtgaccttcttgctgatcttttcgactagtataacaccattaaaaaactatctctcctccataaaccacatattgttgtcctcatagaaaagatggctctcttttccgtcaacaatacaggtataacgtattccggctccgcctgctttcaggcttgccgctcttcttacatctgttactttctgaatctcatatacatggccatccttccagataaagctccttggcagaagccttccgtcatttgtaaattcagccatgacatttacatataccttgctgctttccataatagttcaatccctcctgtctatccaaagtacccatgcggatgtaccgtatgatcagactttgcatcacacgctgacagtattctgtcacggtacataagccctctctggacactgtaaaatccaaatcttttgcggataatatcaaccgtctcatccattttcatctgtttttctcttgcctgaggatccatgaacatgtccagctgctcccagaaataatctgtcacaagatccgttccacgtattcctatgctccgtagtggcttttgaaagaactctggccggctgcttttcagttccttatcatccgccggtagtctgtagttgtctttgtataacctgtatccagcctctgcaatctctttggtgatattgctcgcattctgtaactttacctgttttgaaaaatggaacagttctttgtcgcggacactgatctcaacagtccggcaccgaaacccattctcccggagtcttgccgctacactttctgccaaaatgtataacacaatcttgacatcttcatctgtttccatatccctgggcgttgttgtactgttgcctacagacttgaccggagctgatgtattttccagctttaccggagattcatcatatccattagcaaaagcccacaggatacttcccatcttgccaagttttctgaccaacagcgtttcattagattttgccagatccccgatggtccggattcccatgctatataactttttattcgttgcatttcccacatataacagatcagaaactggaaggcaccaggcttttctctgaaactcatcctcatacatagtagtaatggcatccggtttcctgtaatccgaaccaagttttgcaaaaatcttgttaaacgacacacccacgctcaccgtaatgccaagttcttttttcatcctgctgctgatttcctgtgcaatgtgaaatccgtctcccttgagagttgcgctgtctgtcacgtccagccatgactcatcaattccgtatggttccctcttatctgtatagtcagcataaatttcctgtgccattctggaaaatctgagatacaggtccatccttgggggaagaaatgttatgtccgggcatacctgttttgcctgccataatgccattccggtttttacaccatatctcttggctgtataatcagcggtcagcacaattccatgtctcgcctcaggatcaccgcctactgctacaggctttccccgaagctccggatgatgcagaagctctaccgatgcataaaaacagttacaatcactatgcagtattgtccggttcactgaatcaccttctttcctgctgccggatgatatgccatccgtctacatggcataatataatacttttctagttgctaatcaacggtaatattttgcatattatcaatatggctgatattatgtattgatttttagggattcttatgctaatcttgatatatcccaatagggagatcatacctgatatgattacttagaaaggcataatactatgaaagatttaggaaagaccattgctaaatacagaaaagaacataagctgaaccagagccagcttgcaaaagaactggaaaactatgacatctatgtaaagcagaattcaatcagcgcctgggagcttggcacagcaacaccaaatgccagacaatttctcgccttatgtgaaattcttgaaatatacgatatctatacggattttattggtcaaagtccccttaacccattccgaaacctgaatgaaacgggaatgaacaaggtgcttgaatatatccgcgatctggaaagcaccggcaactataaaccggcagagatcattcctatccatgtgatcagggaaagaaaagttttttacaacaccgtttccgctggtaccggctcttttcttgatggtgacgaatatgagatattctcctctcctgacattccggagactgccacgtttggcgtatatgtagatggtgacagtatggagcctagatatcataataaggatctcatctggattgaacagacagcatgccttgatgatggcgaaataggtatcttctatcttgatggaaacgcatatgtgaagaaatttcagaataacagactcggaacctacctcatatcactgaataaaaaatatgatccgattccggttacagagaacagttccttcaaaatattcggccgtgttctttcataagtcctttttttgggacacttaaaactgtaggattattatagtggaaccctaaaatgaaaaattaaacctgtactttgacaactgaaaatggctataaaaggtgggggcagccactgtaagagtagaatcggctgttttttgatatcaatggcaattttatttattccggtttatacatatgagcctgtaatgaaaaatgttcctaatgccgtgattttattgataggagttcttgctgtggtaattattattgtccttgccccagtggaaagtatcaataaaccgcttgatgaggaagaaagaaggtattatgcaagggtaacacattgcataacggcattacaggtatgtgttcttatcattttgttttgtctggatctgcaagattatttttatgccgggtatgtaagtatagtcctggtagcagtatttatggttatgggaaagattgcagtgaaacgatatgtgaaatagcaaaatcctcttaaaatgatatattaaatttctgactgcttttacataagattgggctaagatgggtagaaatttactctttgtcgtatttcgtgttgaaaaaatcgtacttcgtgcaagaaatattgaaaaaagtaggaaaaatgatatggttatggtgaagtagtaaaaaaattatcaaggaggaatttatcatgaaaggtatcaaaaaaattttatcaatggttttggcgattgtttgtatcattggtcttttcccgacagcaaaagtggaagcatcaattgtaacggtaaatggtggctatacgacaagggctaatgcgtattcatggggtacatatagtacaacaaatacgataactgtggtattgcccgaaacagaggaagatttttgggttaaatttacacttccgaaagaaaagcgtgtgtatgcaagatgttcttacaatgcggaaaatgaaggtatgtatcttgaaatgagaaactcaagtaatagaattttagatgaaaagtacagccctgacgatgttttggatatggacacggttattccatttatggcggtggcttgtgataatctcacttcttcatcacagacatattatattcatgttaatcgtggaacttgtgagggtacaatgtatttttcactttcgatgaatgagagaattaaaactggacgaggagtgttttcttttagtggaacagcatctaatcctggaaattcatcaataagtttatcaggtgtagattcttctgttcttacattgaatttggcaaataatactacaattccaccagaagccattgttacatcagtaaatacatcaggtactcaatcaccgagtcagggaaatgttcatcatatggtacttcctgcaacagaatcaagtacttggtatacatctacggtagcaagtgcatcgagtggacattacaatatagatgtttcggatggatttcaggcagcacaaagatggcaatttaaatataatgctttagcaacagcaaaatcaacaatgaaaaatgttaaaataacactggaatgggagtacgatatagcaaatacaggatataagtcatattagaaatgtgggtgatactatgaatattttttttaacagccgaatttatgctaatcagtcattgcttaatgtcctgtttggtcaacaacaaaaagcgacaatcagtcgaagcaatggttgtataggcacaagagatactttgacgataagcgcatcaggaaaggaaaaacttacaaaaagtacaagtggaagaacacataatacaagtattgatagcagcattgacttaaagtcctatatagcttcagccaaaaaaacgaatcaggagatcattgagaatgcaggaacacagattaatgcgaaaacaagtgaatatatgagtacaggtaaagcatttagggaggcattaacggaaaagtattctaaacttgccgcagaagcaaaaacgcattccaatcctgaaaattatattcattccaagtattttgataagagttcagagtattacgagactaatctgactgatacagaacgtaggattgcatataattatgagatgcagatgtgccggacaggaaagataaatggtgtaaattatcaggattctttgttcaggggaattgaagtggacggtgacagtgtagattcggataaaatccaatttgaaagagcattgataaattcgcaaatttcaaatattttaaagcaggctggtgtagatacatcttctattacgaaagattgtacttttactgtcgatccatacagttatgaaataacggtagatggcgtggatgaagaaacaaaggtgttgatgcaggatgccttaaatgtaggagataacggaaaaaacctctataagcatatatattattgttcaacacaagatggctgtgagagttctcagataacaaaggaatcaaaaatgaaatacgaagcatatcatcaagtttatagttatacaggatatgaattagataaacttgaggaaaaaaacgggacatattatacggagtcaggagagaatatattagacttagtggataaggctgttgaagattctggaaaagttccgaaagagttcaagcagcaaatgaagaattggatacatgacctggtttcaactatgtcaactaaaggatggaacaatgtgccggatatgactttaagcattttatatggaaagagtggtttaaaggacatgaatcagttgatcacatatcaatatgaagctgatagtacaaacaggcaatggtattctgtactttagaaatataatatttttgaaaaaatatagggaagtgtgtcaagtatagtaatatagttttttagataaaatatatgattcgaaatttttaaattaaaaaataaacaatagagggagggaaagcgttttaataatgaatctatataaatcaaaaaactataaaataaagaactatgaacagaaaggaattattcatgaaaaagagaaaaatagcaacaatattattggcagcatgtttgctgttaggaaatgtctcagtagcgaatgcggcaagtattgataatggcaataaagtacatttcaatacagaagataacgacacggatttaacattattacaatcgaaaattgcaaccgaagaagtgacttgtgactttacggatgcaacaaatgatggagcaagtgcatatgcagatacaagaagggtgtcaaataaatatatgtggagtgcaagcacgatggaatataatttctctgatcagaaatggacatcgaatacagaaatttttagtacatatgcaaaaacatcagaagggtttgtaatgtctggtttcttactgaatccaaaaggtcagagcaactataattcggcattaagagaggggtatctgaatgattctgcatatgatgaaaatcagggacattattatcaatgtgttgtttcggatgaggactgtaataatattacatttatgttagaatctaatgttaatgtatttatttttgacaatgatataaatttaatatatcgttcatcggatgaggcgggagttaccagttattttgacagatattattcaacaactaaaacgattgcaggaacgtcgaataaggtaattagtttaggtcttattgatggaaattattatattgtttttaaggtaaaagatgcaacagcaactaccggttatcattatggatattatgctggacaaccattgccaatagcacaaacaacaaccttttcggatcttacacattatacaacaataaagtggaatcgaagctcatctagccaatcagcaagtacgcaaacattgaccattaattgtcctagtggaagtgaagatgagtatgcattgacaggtgtgaaattttcggataaatcaaaagcatttgctaataatacatacgcatcaagcattgactattattatacgccagcaactgctagttattcaaaaaaactagcacaaacaggtggttggtggagtgacttggttgacaataatccaccatcaggatcaattgatggaaactatgcaacatctgttacagtacattgggtaagtggtatttcttatgtaaatgctagttgcactacaatgacacagatgacattggattatttagttcctttcggaataatagtgggctaaatatttagaaagataaataaattacggatggtatttttataccatccgtggattccaagaggtgacgataagatgggacactatgtacattatataggtggcggaatagtagatagtaaaatatatgagacaggaaatgcagcaaaaagttttaaatcgccgatgaaagaattaaatgagcaaacggtgttaatagaaaatgccaaaacaaataagaatgatagttatcatcagcatacgaaatacgatgatcaggtagatcgctattacagtacatatgatataggaacattgttgcataataatgaaagttatttagagggaacaatcgattcaaaatatgatgtagattactattctttttcttatccgcaaaaaagtttttactctaaaatgggtatatcttcagagataacgatttcattggaaagcaagaatagtcaggcatataatttagtattgtacgatttatatggcaatcagattggaatagcgacagatgatggacatggtaataaacagcttacggtacctaattgggactgcgttacatcagattatgtgatcagagtagaaaattccaatatgacatcggattccggggaaggttcctatagaataaaaattacggaaacgaaaaacagggatacttcaagtagtaatgtgcagcactcacaagaaatagcaaatgcagataattcagaagaaaaaaatgcaataaagcagaaatatgaaaaaacatatcaaagcgaaattgacaaattacatcagatgcaatttgaagcgttgccggaagatgaaaaatattcgggaacggatagtgtagaagaattattaaataagatgaaaaagggggagcagttaagtgtgtcggaaatggcatatgtgaaaatatttgccaatttatctgattatgagagagcagagaagtcgaattatataaaaaacgatttttatgcagaaatagaaagaatagcaaatgaaaaaggaattgaactgccagatacatcatggaaaattgaaatagatgtatctggaactattacgattaacggggacattacagaagaaaacaaagaacagataaaaaatatgatatcggaaaattttgctgatgatatgtgggaaaaatatattcagacagcagatatttctaacacacaatatagattagtaaatgcttactatgaagtggaacagttcattcagaaagcaacaaatggacagtattcatttgacgatataaacgtagatgacaatgggaagattaccggacttccagagaaaatgtgtaaaataatgaactcccaggaagccaatgcgaaatatgaggaaatacgagataatatctatatgctgacggattataaaaatcaatatggattggaggatattcttgcatttaaggcagggtataatatttcggactctgaggtaagtactgtgggtacatctggcaataatagtgttatggataatgcaggatactataaaaatatgaaaactataatataatgatagaacctaatagaaatggcgggtttaaaagacatgaatcagttgattacatatcagtatgaagctgatagtatggacagacaatggtattctatactgtagcaatataatttggggggaaaatataggaaatgtgccgtcaagatgatggcacattttctatatatatgatatttatttagagcctatttagataatatgcagagtactttatatttatttaatggaaaaataaaaattaccgatatagtaggaagataggaagaaggtgagtaatatgctggaaattgctgtttgtgatgacgatatagcagatcttgagtgtgcagtgaatatgctgcataagatttttacaagtcaaaagattgcttatcatatagagaaatttatgtctgcaaatcaaatgcttgaaaatatcagtcgtattgatatcggaattttagatatttcgatggaagaactgaatggtattaaactggggagaaaattgaaagaaaaatttccagatgtgaaattagtgtatattacgagttatgaagaatattgtatgcaggtcattaacgaagttcatgcattttcatttctatgtaaaccattggaatatgataaactggaattgcagatattggaacttctgaatcaactgccggatgccatagaagaaaagaatttttataaagtgactgacagcaatggaaaagagtatctgtcgatcaaactgaaactgagggatattttatattttgaatacataaaaagatccagaaaagtactgatagcattgtctgatattacatatgagtatgattgtatctttgaaaaactggttgaagaactgcaaccatatgattttgttgtgaattgtagaggaaatctggttaatttaaggcatattgaaaaaataaagggctttattatttatatggataatggaaaagaacttcagattgcacaaaggagaagcaacgattttagagaagaagtaaataaatttttgcagagaaattcataggaggaaaaatgaatacgattttactggtattatgtaatgcactttcatgttttataataagtacgatattatttcagtttatgaatggaaagtataaaaagagtagtcgaaatagatatgtatatattgtgattgagactaccacagtaatatttacattctgtataaatatgctcaatcattccatattaaatctagtagtctggggcgttttgacggggattatagtatatgttctgtattatgaggatatagataaacccttaagacgtattattgaatgtgaagcattagtattttgtatgtctgtctgtgaatcattgggagtgattcttttacaatgcattttgcaagccgcagatataaaaaatgtgaatgaaacgatgctttattgccttgaggtaacattttcaaaggtgatacttatttttttgtattacacattcataaacaggtttgtgaaaaaaagtgatgtcccttattcaaagacacggtacatcatgtatggaattatacttctatacagtctgattaacatgagtgtaattgtagagaattttaaaaatggagaagaaaattatttgtgtgcagtcaacatgggatgtattgttctggcagatttataccttttatattttgtaaaaatggcagatgaaaagaactattacgaaaagcagttgatcgcattagagcagcaggcaaaggtacaatacgaatactatttgacccaggcaaaaaagtatgatcaaaccattcagatattacatgatgtaaataagcatattaaagcaatcgaagggttatatggtgcagagcaggaaaaaacggcaggagaatatgcaacaaagatcagagagttgttgaagccgcttattccggttcaatacacagaaaatccgatcttgaatatacttcttacagataaagaatctgttatgagagaaaaggggatttcagtaacaataaaggtagataatgtgaatttgaatttcattgaaccaatcgacattacaactatttttggaaatttattagataatgcgattgaagcaacagaaaagctgaaaggcgagaaatatatttgcattaagattggttcatatcataagatgatagttgtcagcattgaaaataattgtaatgaagtaaagtggagaaatggttttccagtatcaaataaaggaaaaaatggtggaataggattgctgaatgttcagagcagtataaaaaaatatgatggagatttaacattgaagaatgatggaaataaatttgctgctgagttattccttaattcataaaagagcatttttggctatttttttgtaaagagtcttacttcgtgcaaaaaaatcgtacttggtgcagaaaaggtaaaatatcagaaggggtgtgtcgatagtataaagaaccggacaaaaagatattcttcactggtaacggaattgagttcataagtaagcagttaatttagcaacaacttgttgcagattctaaagttatcttgcataattaaaatataaaagatgtatataaggtcgaaacagagaccttaaacctgttccagtggtcgggatggagaccgaaaacccattcccattgcggaataaactgcaaatacagtgatcgcgttgcagaaacctgtgaggcctgcgaccgggggagaacctgcggggactcctcttttctatattatggagatggtgtatatgcagaagatgcttgattttataacatagaagagagtacgtgtaatgcggagtaaataatggtcaaaaaacaatcgacatccgacctcacacacgttataatatagataatctaataagaaaacagtgttatcattaccgcatattcagtgagaatggtagccataaatatgaattcgcaggaacggaatggttgaaccctcagggtgacagtgtcactcatttgtcagcgagaggtgcttaacttggatgattttcagttttcttattttgacatggatttacaggaaagtcagtaaaatcaagttgttgcttgacttatgttgaccaagaaaaacatagattttctgtagtgacttgaactcctaagcgaggggtcggaggttcaaatcctcttggcgacgggcttcaaagcgttcgaaaatgttagctggattagctgacaacgaacgcttttgttattttcaaatcacgttcgtgacacaaaattccattcaaaatgatcaatttccagctaacatttggattccgctctgttgtcaccccttattcggggatgtaaatcagagaaaaggcgggaaaagaaacaatctctcccaaacctgcaaacatgaattagctgaaacagtattcaattctattagctgtagctaatagtcaaacagcaatgtctgtttggaactttactatttataaaagttccaggcaggcattttttagttcctgaatcctggaggaaaggagtcaagatggctgagtgagaaagcttttgcttataagatgaaacttgaggcaatgaaaaggcagggaatcagaacagatttaactttgtctcaaaatgagacgaagttgaaatcggatgaagtcttgagtaagcaagttggggaaagtagagctcaggtacaaagatttgtacgattaacagagcttattccggaacttcttgatttggtagataaagctcacaaggaaagcagagttgcagagaaagattgatgaaaagacagattatattgatcgcctgaagattggactttcaaacatggttcgcaactatggatttgagaacatgaatgaattttatctaagttataaggaatctaagacggcatttgcagattatcagcagaaagttgaagattggaagaaaggctatgacaatgtagttgtttcaaaggataagacagaaacaatgtcggagaaacttgatagactgcagaatgaggtggaaagttccaggcaatataataaacagaaccaagccaaatgggcgagataaattcttctgttttcccaattatatggattactatgttcttctattcatgtttacaaatttgttagcataaattgatgaccttttcacaacaaaaaaaggtcaattcacaacattccagatagatattgcatgaatttatccgatataatagctataaatatatgtaagcaaggaagtgacaatatgcgaattgctatctgcgatgatgaagtatctatggttcagatactggaagaaaaaataaaaaagttattgccggatgcggttatagataaatatttatcgggtgatgaactgatcgcaagtggcagtaagccggatattctttttctggatattcagatgccgggaatggatgggatggaaacggcaaagatgcttcgtcaggacaatgaggatatgatactcatttttgtgacagcagcagaggagtatgtttttcaggcatttgatgtcggagcatttcattatctggttaagccattttccgatgagaaattgaaagaggttgtgacaaaggcagtccataacataaaaaggagttccagacttgaaaaagacgaaaagtatattatggtacagaccgccggaagtcatataaagatttttctgcgtgatattgtgtatgccgaggtgtataaccggaaagttattatccatacacgaagtacggatattgaatactatggtaaattacaggaattaagtgatatggcaggaacagattttttccgaacacacagagcctatcttgtacattttaaatatgtagaaaaatatgatgcaacttgtgtaactatgaaaaatggaactgcattgattgcaaaaaagaattatccggagtttgtgaagcaatatctgaagtataaccagaggaaaggaaatgaagtcagatgagtttagtggaaagatgttggatgatcacatcgaagttttctgttattgcaattttgattattacaggaaactgttttggtgtttttgtatatccatatatgaaaaagaaaagggaagctgctctggtcagtattgtttatattggaattatgtctgtgctgtatctgataccgcagcagattggcaatttttctgcatatatgctgggagttgtggctgcatttcttgtgatgtatgtacaggacagaagaaacatttatcagaaaatatttcttgcagtgacatttttttctatccgttggcttgcggttgcaatggcaggcagaatggatgattttatcacaaaagctctggtttttggaaatacgattgcaggaagacaatggctgcaatatgtactttatgctggaacgagaattctggatattgtgctttgtatcgttttccttgcagttgcaatcggtctgatcaataaagcatatgtatacaaaaatgatgaaatgagcgttaaagagctggtaatgcttatcataccttctcttgtgggagttacagggtatggtattctgcaatattatctgaatatttatgaaaaagatacaggaaagagcctgacagatacctatggattttatggaactttaagcttcgtgcattattttatctctatcatagcaattcttgttatgactacgatgtttcaaaactggaaggtggcacaggaagaacagacagggcaggagctggtattaaatcaggtcagtgatatgaaaaagcatatcggggaagtggaaaagctgtatcaggatatccgcagcctgcgtcatgacatggggaatcatatacagatgctggaacatcttgtggcagagaatcatatggatgatgcagcagaatatatggagcatttgaaaaaggagtggaatgaaatatctcctgagataaaaacggggagtcctgtcattgatgtgattctgatggaaaagttaagagaagcaaaggaaaagcagattcgttttatatcagattttcattatccaaaagatacgaaattaaatgcatttgatttaagcgtgatcttaaacaatgcactggataattgcatggaaaatgtaagtggagaaaatccttatatcagtatctcttcttttcggaaaaacagtatttttatgataaccataaagaacagatatgagggagagttaaactataaggacagtgatctgccggaaacaacgaaatccgggaaggagcatggaattggactgcataatatccggagggttgcaaggatgtatatgggagatatatttttagagcaggagaatcaggaagtggttctaagtattatgttacaggtagaataaggacaaaaagcactaagtaatctgtgaaacatcagaatatttagtgttttttatttgcttcacaacaaaaaaagggcggttcacaacatcgctgtttattgtaaagaaagatatgccgaaagaatcagtaaagagaaatcatgttgtacagatttttaaggaaacggatttcagaatttaagctcaaggaggacaatacgatgaggatcaatggatttggtgggacaaatacgcagacaggaacaatgggaatgacacaggggaatgattctgtaagtaaaaatattcagaatcagattgcaaatgcacagcagaagctacaggatttatcatcgaatgaagaaatgtcattagaggataagatgaaaaagcgtcaggagatacagcaggagattaacaatctcaatcagcagttaagacagcaccagatcgagcagagaaaggaacagcagagtaaaaattcgtcatctatggatgatatggtggctggaacaagtagcacttctaaaaagaaagacaccggattgtcacaggcaagtatgcaggcgatgatctccgcagattcttccatgaaacaggcaaaggtgcagggaagtatggcaacacagatacagggacgtgccagtgtgcttgaatctgaaatcaaacaggatgccggaaaaggaaatactgagaagaaggaagaagaactggcagagctgcaggcaaaggcacagtctgcgacagcagcacagatgtctacacttgcagatgcaaataaatcagtagaagaagctgcaaaagcggagaacagcaatacagaagacactgcaacaaagaacaatactgataaatccgagaaaacacaggaatctgcgggggctgcggcagaggagacagacagcgtaaagaatacggatatcaaaggggaaacacaggtgacagtagaaacaccgactctggaaaatgcacagaatgcaacacagcaggcagtgtatacaccgattgatattcgtttatagttggtaaaggagaatggtattatgtcagagattaagagttttagtgattacacaagtaaatataacagcaatgtagattattccgcattatttggaggaacttccgacagttcatccgtaggaaacaccaatatgctttctgattatgctgcgattaaaaacggaagctatggaaaacttatgaaagcatattatgcaaagcaggatgcagaaaaattatcgggtaaaggcgatacttcacagaagcttacactgatgaaaacaagtgcggattccctgaaaaaatcagcagatgcactaaacgatgcgtcactctgggaaaaaaagaaaataaaaaagaaggatgaaaagaccggggaagaaacagaggtagaggattatgactgggatgcaattaccaaaaaagtgaaatcttttattgatgattataatgatgttgttaaggaggcaggagaatccaatacaaaagatgtccttagaaatgcttcatggatgacaggcatgacagacaaaaccagtcatttactttctaaaataggtattaccataggaaaggggaataagctggagctggatgaagatgaattgaagaaagcagatatcagttcattgaaaacggtttttacaggttacaattcctttgcaggcaaaacagcccagaaagcaactggtatatcaaatgctgcgaaccgggcaaacgcaacttatacaaacaatggtacatattctaaaacgaattcttctctaacgtcaagtaagattgataaggaagtataggaatattgtatgagtgactaatttaagtaaatgtatatcactaattagtaaacatgaaagtgaataggcgattgcgaaatgtgaaaggagaggatatgaaaatatttcaaacaccttcttacgataggttttgtttattcgaaatggaaagaaagagtaaagatttcagaggtatggatgacaatgttgcttataaaaataagcagatagacaatgtagaaatatcgaatgaaggaaggcgggcattgcgggaaaaattaagagaagtaaagccaaaagttgaggaaccgataggatatgaattaacaatacaagatacaaatgaggttgaatgggaacattatacttcaatgagagaatatagtggactgacgttaaaagacggaaaatacaatctagaagatgtgatgaagtctatgatggatgcttatgaaacacgttacaattatattgtgaaagaacatgagaatggagaacgtcaggtttcttatgacctcacaggagaaaattcattaacacttgatgaagatttggcaggtttagacagggcatataataagcgattagcaaatctggcgggatatattgtatgtcagcagacaaatgacggttctaaattctttcaaacaactaatgtgaagaagaatacagcagaacaaaaagaatatatagatactgcggtatccatgatggagaaagcacaaaaaagatttttagaaatgcgtgaagaaccgaaatacacagcaggaattgcaaagagtgtaatttgggatattatgagtagcgataagaactttatggaaacgactcagaggttatttgctaaaacaatatatcacaatacttaaaaaaatattttctagagacatgaaaggctgtttaatgttataagagaatgttggcagttgttatgagacttatataaggtaggggatagtatggttactgtaaataattattacaacaatataccagtaggcagggatttaaatacggtacagtaactggtgttaaggctggtaaggcaacaatcacagctaagattacagttggtaaggattctgccacagctactaaggatgtagaagtaaagaactatgttcttaagagtgtagcacagaacaagacaaatgagcttgttgcaactatcgatggtgctacaaagaatattaaggcttctgatgtaactatcaaaactcctgacaatgtagtccttccggttaagtctgtttctgtagacagcaaagatgctacaaaagttactcttacaacattctcagatatgaatgatggcaaagagtatacagttacattagatggaacaactgtaaactttgttgctacagacaacaaggttgcgtccatcaatattgataagcctaccattccagtaaaaactgagacagagattaagttagttgcaaaggatgccaacggagttatcttaaaagagcttccttacggaacatctgatgtaaactatgatttctcacttacaacagcaaacggatatgtaaacggatctaaactttacttaaataaagttggtgacactgcaacagccgagattacctataagacaaataagtatacagcagatggtaaggcagatggaaacatcggaccaaacaagcttacaatcacagctactgatcaggctactgtaagttctttcaaggtaagaattggtgatgctaataaaaaatttagttctttaaaggacaatgataaaattgctgtagatgagacaagcgctgtatgggcatactttgaaattaaagacactgatggaaaagaaatttcaaattacagtgactacaaagttgagtcaagcgataagacaacattaatgcttggcagtgatacaatgcagacaaataacaaagtaaagcttattcctgcaaaagaaggaacggcttacatcttcattaagaaagatgataagattgtcgcttctgtacctgtaactgttgtagcagcaagaaaggttgttactatgacagctgataagactgctgttacagtatccaagtcagcaaatgcaaaccaggaaactattacattagcaactaaggatcagtatggaaatgattttgcgtttactgctaatgatggttctattgaagttacatgcgaaggtgcaccggatggcgtagacaaagcaaatgttactgtaccaggatatgcatcaaagaacggcaataaagtaaaatatactgttactggatctaactatgtaaagggaacttatacctttaagtttactttcaagaaagacggaaaagaagtttgtgcacaggttgttactgttaatgtacaggaggctggtgtagctggtgattctatttcctatagccttaatattttaaatagcaacaatgcaacacagacagaagaagatgccgtagtaaatgcagataatactagcaatcgtatttttactgttaatgtatctgaattactgaagggcgtggaagctaagaaattagctaaaaacgatagcttggatgacacaaaagatactgaaacagataagactgccggcaaggtaagaggtatttactatactgttaaaaatgcaaagggagatgttgtatacaacacaattccgggttcagttaccacaggtgctgcatttaacgatggaagtttaagtgctactgatcagttaacaatcaacgttgttaaagcagatgcttctaatgtatacgcaaaacttgcagagggaacttatacaattacagctactattgaagttgaaccaaagcatactactgcaggatatacttatgattctacaaagaatacaaagacaacaattacaaaatcatttgttgttaaggatacttccaatgatgcaatcactgatatgaagttaaaggatgcaaaagttacttccggtgcttctattcaggcatctcttgcttctgtaatccagtattcttatgatggtgttaaatatggtgcagatggagatcagtcagctactatcattgctattgaaggatattcaaatgtaattggtggcaatggcaaaattacagctgataatatgactacagttttaccttctggaaaaactgctgatgtaacaaaagttactgtaagagttgcattccatgatgcagatggaaatcttatcggacatgtagataaggaagtcaaggtgtcactttctatcacagctaaataagactttattttagccagactctgagcgagaaatcgctcagagttttttattaggttatttttatgaatattatttataaagatgcagatgcaaaatttccgataattgaaattttcgcagtgcgtaaatctatttttttataactttttttcaatgcggatttaggaattattattgtacaatccttatcactatagctggcaacatttgtcttgaaattgttcttgctataagatacaaggcttttattcgaagaatcttttacagaaactttgaattttgatacatttgtgattttcccataactattattgaccaatttaaattttaagtgcaaattgccttttgcatcaaatgatgctgcatatgccttcatttttgatgtattgtaaacaacatctttgattgtaatttttttggcttgatgcttgtttggttttactgaaacgacacatgacatctttttgttatttgacaactttaccgtaattatagtttttccgatgttttttgcggaaatttttcctgaattatttaccgttgcaactttcttattgctagaactacaacttttaatagttcccccttctgcctttaactgtttgttaaaaccttttgtaagatcaagttttgaataatttaattttgtattttctgaaattctgctaacagttagatcataattaacttctgtttcaaaattcatttcaagaatataatctccggcaggaagatgcattgtatgagccagcgtgatattgttgatacaattgaagatatttatggatttgagatttcacacgaaaccatttcgaatatcacagatcaggttatagaaacagcaaatgaatggcaaaacagaccattaaagaaattttacagttttatctttgttgactgcctgtatgtaaacatccgtaaggaaatggagacaaagaactgcgctgtttatgttgtgctcggatatgatgtaaacggaatcaaagacattctggggatatggattggagaatcagaaggcaaacactattggatgcagattttcgatgaaatcaaggcgcgtggggttgaagacattctttttataagtatggatggggtgtccggtcttgaggaaggggcaaagtctatatttaaggatgttgttgtgcaaagatgcattgtccatctgataaggaattccattaaatacattccctcaaaagattataaagcctatactgcccaattaaaaaaggtttatggggcatccagcttaaaagctgctgaagcagagtttgaatgctttaaacaggcatggagccaatatcccggggccatagatgtatggatccgtaactggtcaaatatcgagcagttattcaattatggcagtgctgtacgaaaagtcatgtatacaacaaatgcgatagaatccgtaaattcaagcttccgcaaggttactaaaaaaggctcatttccaagcgaagatgccataatgaaagcattatatctgcgcattaccgagctttacaggaaatggaatggcagacctgtggctaattgggcactggtaaggaatcagctttcaatggatgataagatgcatacccgaatattaaaatacgagaattactaaggagatttcaaatgagcagacggaaatcagccccatatgaagtagatgatgaattttttgcacaactcgattttctgcggaatgactatgaccaagcactgaaaactatagatcaacagaaagctgatatcagacatcttttagctttactgataaaagaagacatccctgttccagaagatttaattgaccggtatattcgcaaaacatctgactcaaaatccatagatgaagaacttccgtttgattgaagctcgtaaaaatggtggtcgatttatcgaccaccacaaaaaaatcaaaaaatttgcacactttacttgacaaactcaatatcttttgaaaatgaagtaattctatcctcttgtcgttgtaaaaaattagttaatctattctcaattttacagaatttaatttctttatatttctcaagattctcagtaaatgctttgtcatacaatttttcttctaaatatttctctaaatcattccaactaaattgtttatcttcagtttctctgtatattatagataatagttctggaacattatcaagatattgttgtgaaagtagcatttttttaaattcggcataagaagtatttattcctacagccaaattaaacctgttacctaataaaaaagatgtatgaatttttctcctttttaaaaatccaacttctatactattataacatagaaagttggattaatttaataaatttataatcacatttcaaattcccccgattaaaatcgggggaatcaaaagatgaaatattattttatgaatgtaaaatttttattcacctactgtgatagttaagtttactgggacttcgatgtttactttataccccttatcaccagtcttaacttcaacagcaatcttagatacagtaacctttttaccctttgtggtaagagtttctgttgcaaagtttttactgtcaatcttcttattatcgcttgtgataccttcaacatttgtaactgttaatggctcatcagcatcagatgctgcgtaggaagttccttcatatacatacttaaatgctgctttagccattgcctcgatagttccgcctgctacagtatctttaacacgtgaaacctcaccagcaggctgagaatcttctacaacaaagcttgtagtaaaagtagtcttaaccggatcattagttcccttctttgttgtaattacagctgtaacagtatatgttccttttgcaagatttttctgagcactgaatgcgctgaaagaaaccgtattaacagttaactttccattagtagccttaatagcagcgttagttacattgttaaccttagtaacatcatcaaaaattgccttgccatctttatcaactactttataagcgatagattcaacatttgttgcatctgcaccagtttctccatctgcaattttgtcatttggttttaatgtagcatatggaacaccaccgattgactcagtaacatctactgttacatcatagcaagttcctgccgcgtcgttatgattatcatcgacaagagtatcaacctttgcagtatttacattcagtgcataggaaacgcttccctttcctggatctgcaggagtctgaacatttacatttactgtcttagcgcaaacttccttaccatctttcatataagcaattttatatacataagatccctttgtaacgcttgctacattaaatgtaacagctacattatttcccttctgtgcgacagagaaatatttactagaggcattagctgtaacatcgtctgtttttaccttgtctgcagatgtgctcaggcaagaaacagaaaccttatcggcatcacctttaatatctgcgccgtactgatccttaaagcttgcagtaacagttcctgattttgccaactgtgttgagagagctacagaagccttatcaacagacatagttgtaactgctttttcagcaactactgtaattgccacagaactaacaattgtgttatttttcttaattaacagatacgcagtaccagcctttacaggagttaatacagcttctttatctgcgatagatgcatcatctaccattaaaatgctgttgtcactagactctacagtataatctgtgtagtaactaatttcgttgttatcaacatctttaatctggaagtaagctgtatttgctgaagtctcacctacagcgatctgcttatttgctgcaactttatcaaactttttaccagcttttgcgattttaacatcgtagctgtttacagaagcctgagctactgctgtgattgtaagctttccagatgtaatatttccttctggcttaccatttgcatcatatttaccagttttgtaagtaacctctgctgttgcagtatcaccaatcttatttaagtataacttagaaccgtttacataaccattgtatgttgtaagagagaagtcatacttggaagaataatccggagagctagggttataagcatactcatcaagaacaacaccattagcatccttagaaactaacttgatttctgtctcggttgcaaccggaacagtgagtttattaacgtttacagatgcaactttaccatcagatacaacaacctgctttgttgttccgtcaagtgttacatcataagtctttccatctgttaatccagcaaatgttgtgaatgtaacctttgttgcatcctccgtacgtacggttcaatgggaggggcgagataattattctccctctaccctattatcaaatcacagagcaatactgcatttgagagtgttattatgttgtgtggggagccactttttgtggttgttacttttttgaataagcaatttcaaatgcttttggggatattgttcttattgatatccgtgtcggatgaaatctcagatgtaaaataaaaattgaatgattgtgtgagataaaggatgatagggtgagtttttggtgcccaagaaatagaaatatttgaagagggagcaaaagaattgttgtgtgtggggaacagttttttgaaaagctttcagaaagggtggcatggaagaaatggtactaaaagcgcataaagagattgcaaagtactactttaagcaagaattttagatgatgtaaaggcaaagtagtactataagcaagaatgaagcaattaagtactactttttatatcaaatcatgatgggaaaaagaaaaaagtagtatgaatcaatgacagaagacaggcagtcgttgattataccattggaagagaattgtacacatcggattcgggcatgggaacaggaaacatatgaaccatgcaataaatacccggagacattgaggtatgagacaaacgcaggtgaatttgtgcgttctaagtcagaggtgattatagcaaatctattacatatgaaagcagatcagcttttatacaaatatgagcggccgctaaaattaagatatcaagggcgtaaaatcatagtttatccggattttacaattttaaatacacagacaggaaagtttacctattgggagcatgcgggactgatgagcaaaccagagtatgtttctgattttgtttggaagaacagtttgtattatgagaaccatttattgccggggacagatgttttattcacttttgaaacggaagatcatccgttggaaatccgcacgcttaagcatatgatttcggatttgatgacgtaaaagagtagatacaggcatctataaaacagatgcatttgtatccagaaatttacattcctgaaaacttgtatctaattggtacggtcaatatggatgaaactactttcccatttagtaagaaagtactggacagggcaaacacaattgagttttcatatgttgatttagtccctgattttgaagaagtacaagatgctgaagcttgtgaagtaacaaatgattttcttaaatctgagtacattgttttaaaaaaggatgtggatgtagaagatcagaattttgttatcaaaatttgttctcagttgcaaagtattaatgaaatattgcaagaggctaattcgcatgtaggatatcgcgtcagggatgagattgtattttatatgttgaataacaaaaagagtggattattggcagaaaatgaagcaatggataacgaaattatgcaaaagattcttccgcgtattcagggaagcggaatatctgttaaagaattgttgattgctctttttaagaattttgcaggagactatagcggaatcagtcaagactctgtatggcgtcaaatggataagtatatcaaagataaagaatgtgtatacaaaaaatctgcagaaaaaatatgttatatgatgaggagatttgaagaggatggctttacttcctactggctctgataaaatattggagattaatacagctgaagtaaatattgttattaaaagtaaaaagaactggtcggggaaaatgcttgaccagtcttcttctattgttattgacggccatgatatcaaaagaattaatgattgaagcggctggtgtttgcgaagaatttgatgattgcgcagatgcagcagtttacaatttgaatattgctccagtcttctttgaacaaaccgattgaggcactgaaagaaaaagcatttaccggcggtgcagaaaaatatctgtggattcctccatcattgccatattatgagatgcagggagcatataaaaacagcaaaggcttttcaaaaatacttgtattttctgcatgggagatggttccacgaatgataggtgcgcttgtttcctatgaggcggaaagacttacagttggaaaactggtacatcagataaagaatcaggataagaagaatacggggtattttgcggatggttcgagacgatacccggtggcaaggctcaggtttaatgtttcaaatggagaagtaagaggcatgagcctgtttgccctgctttatccttcaaagacactttctgatatttattcaaggagttcaaggacacaagtggattgaagaaattgtttatcgacttgagtccattttcaaagggaaaagaaggttgatatgatgagaatacttttttgtaacatagcgtggatgaaggagtatcgaggaaatgaagatggaaaggatactccgttaaatggtggaagctatgttgatgagacaggagatgcacatgaaaaatataattttacaccggtgaatatggagggcaaggagggcttatactgtctggggtttttcgagacaaaatcacataatggtaaagatgtcaatcaaatgcggattgagaatattgcaggttgtgaactattaaaaaaagaagaatctgtagatgatgtgcttgttgtgtactgtgcaaagcatccggcgcataagtttacaacggtcgtgggatggtataaacatgctacagttttcagacattatcaagaggcagtgtttgctccagaagatatacaatattacaatgcaattgcaaactcatctgattgtgtcttacttcctgcagggatcagatcaagaaaggtacaatgggaagtcccaagaaaatcaaatggttgggcttatggatttggacgggcaaatgtgtggtatgcaagtgaagaagatagcaggttacaagattatcttacgagattagtaaaacagattgatgaatatgatggcgaaaattggattgacaagtacgctgagtaatgaggtacacatattatgggaaacgaatcaggtgaatggattatgcatggcatgaattgggacaacccggattgcatccattctgtagatgaagcaatcaagtatataaatgaatttggctttttaccattatttaagaatgacatagatgggttttcacttgaagaaagaactgttccagagtactggtgcagtgataatccggagattgatccatggatgtggcgggctattatagcaaggcggcatgatatcgtctatggaaagttctttgataagaaggcaggatttatatcaaaaaagtggcttcctgtatttgctaattatcgccgggatggatatgattttgatgcattatatgatgatgagaaagcacctaataagcataaaaagataatggtcaattttatggatgataatgctgattcagagatttattcaaatgaattgaaaaaacaagctggatttggtaaggatggagaaaagggatttgatggtgcaataacgaatcttatgatgcagatttacctgtgcaactgcgattttaagaagagagtgaataagagaggtattgaatacggatgggatgttgcagtatattcatccattgagcatatctatggatacgattatgtgacttcctgctacaaggataatccacaggattcatggaaacttcttgtagactatatgcatgagatgtttccggatgcaacggataagcagataaggaaagtgttaaaataaaacagtgcatttttgaggtgaatatataaatgaatgcagaaaaatcagcagattatcgcaatctgatagaaattgtaaaaaacaaatatcgtaaaaatcctatatatgctaagagcctgacacttggctggtgtgatttacgtcagggagaagatttgtgtcaggaaattaacctatggacatattggcaagtatttgccgtaggatataataatcaaggtactactgaaatagagtatgatatttcaagagaaacgatatttttgcataaagaaaacgcagaactatatctgttcatgtgtaataaatttaataatattgaatcatgaattgatttcagaagcagaatttcgtgatattcatgttagatttgttaaggaaattaaaaaacttgataaggacgataaaaagaatgttatcttgtatactcagttgcatttaattatttcttgtttggaggaagtggaattatgtttaataaagatgatttgattattccggttaatgaatatgtttcagctgctacaataaacttggattgtattgatgtatgcgaaagcatagtgggacaattggtttacttatatgaatgtgttaaaaatcaatgtcatttagataaggttttttatgatgaaaacagtatatcatatgcgttcatgcattgaaaatactgttcagttaagaaatgctgtatttttttggtgcactaatgcgtagaaagcagatgtatgatgagttcaaatcatttttttgtgtatgacaaaaagacagattgcatatctgcctcataatgcagtataatggtaacgagatttgtgcaacccgatacatgaaatccctatttctctttggacggagggggataggatatttttgattgtacctgacaggtgtcagatacttttgtatgagaagcatggactctgtttcgttaccaccgtgtttgagatacgccctgcatatgtttactgcgatggcgaaattaattttatagacgtgtttggtatttttagatgtttttaccacagcgttagaagtcactaattcacagaaattatacagaatcatacgggcattgatttcctgaaggattccatcatacttgctgctgtgccagttgattagaccgatggtgtatttgagttcacggaagcttgtttcctcgccccagcgcatccagtaaagtttattgatttcttccagaggaaattcttcttctgaaagattggtggcaatacagatataggttccattatcaaggcgaacacgtacaatacggaattcaatatcgtaatacatgcagttttcatcaagaaaatcaaaatcggtagaaggctgaagtatggtataggtgttaggattccccagtgtttctttcgtatggcgtctggtaagtgttgttcttatatgagtatcgaattcgctgtcaggcaaatcataagcggaaaggataccattactgttgatatccttcatgcggataacgaaatacattcccttccggatcaggggtgcaaaggtattaaaactttcgtaaccactgtctgccataaggatggtattattacaatacttatgaaaaccatcagatcagtgcagtagatatgcatatagaaaatctggatagtgataaaatgatttgttatccagtaattcaaggagaacgaatcaactatcaaaataaataatgttttgaaatcagggatgaggtagaaaggaaagttccatgataaaagatgaagtaaaaaaactcaggatggacagtccggaatcactacagtttttaaataatgctacaaaattttataatttaatgatgatgtatcgttgtgctattcgggagatacaaactaaacttgaggttttggatgatgaattttcagttgagaacaatcgaaatcctatttcttttataaaaacaagaattaagcagcccaatagtatttacgataaactgcagaagatgggatatgaatttacaacagaaaatatacagacatatctcaatgatgtagcaggcgttagaatagtttgtgcgtttattgacgatatttatatgatatcagatttgattacccaacaggatgatattaaagttattgaaataaaagattatataaaaaatccaaaatcgaatggttatcgaagctatcatatgattgttgaaataccagtattttttgctaagggtaaaacacctatgcgtgtagaattacagattcgaaccaatggtatggatttctgggcaacattggaacatcaacttcgctataaaaaaggaattgaagaaatgcctggctatgatgagataagtgaagaattacttcattctgcaagagctatcattgaagcagataatgaaatgcagagaataaaagacaaaattggtatgaggatgcaacaaaggttacattcacaacatttgctggattaacagatggaaagacatatgatgtgactcttgacggaacaacaaagcaggttgttgtatctgatggcaaagttgtatctgtaactgttaataaactcactgttccggttgcaactgagacagagatcaagttagtttctaaggatgctaacggtgttattcttgatgagtctgcttatggatctcaggattcctctaagtatgatttctcacttacaacaagtaatggatatgtaaatggttctaagttatacttaaacaagattggtgacactgctacagcagaggttacttacaagactggaaagtatgatcagaatggtaagccagaaggaaatgttacatctggaaaagttacaatcacagctgtagatcaggctgctgttaataactttgcagttaagatttcaagtgttacaacaaagaagtttgacaagattgatgcaaatacacagattgctgttggagaaacagttgcaaatggaaatgctaaatttgcatacttccagatcaaagatgctgatggaaatgaagtttcaaattactacaattattccgttgaatctagtgataagagtatcttaatgcttggctcatctaaccttgatacagataagaaagtacttgttacacctgtaaaggctggtactgcttatattttaatcaagaaagatgataaaattgttaattcggttgcagttactgttgtagctgaaagaaaagtagctacaatggatgttaacaaagcatcagctacactttctaatactagtagattgtcacagaccgctacggtcaccgcttctttcaaagatcagtatgctaaggatattgacgttacagaaggagtagaagttacttgcctgagcactaatgctaaggatattaagacagaaaatgtaacatctgcaaatggttacttctcggctgttacttattctaataacaaagctaccgttactttcaatgcatcaggtcttacagctggaacttaccagtataaaattgcatacaagaaagatggtaaggaagtatgtgctagagttattacaattgtaattcaggatgcaaaggctacaggatctatctcatttggattagatgtagataaaacagaggttgataatcttgtcgacgataagcataaaacagcttctgattatgttgtaaacattaacgtaaatgaattacgtaacggtgttgcatatgagccagtgaaagtaaatacatcttatactattggtagtgatacagaagttgttaaatctgtttcttacaagattgaagacaaagatggaaagactgtatatgattcagcttctacagatactaaattaaatacagtaagtggatgtgctgttgatgctaattatgcattaaaggtaacaactgtttctcttggagcaatgaccgcttcaacacctgctcagaaatattttggagctggcacatacaaagttactgcaacagttaaaactgctaagaatggtgaaacagatacaaataagtatattgtaaagacatttacaactacatttactgttaaagattctcagccagctggtacattatcatttgagaaaaatactgtaaaggatgcttcttctgtatatgacgcagtagttaagtctgctaagtttgtatatggcgataagacatacaaagatggatcaactgatggtattacagttgttgctgttgaaggtttcactaacgatggtaagaagattgacaaagactcaatgaataatgctattgcaagtgctactgattcagttacaattactaaggttacatttactgttggtgatgatacaacaagtgttaatgtagatgcttctgcttctcagacaattatactgaaataattatgatatttcataaaaagaggttgctccggcagcctcttttttagtagaaagggaaaataaaatatggaaaaacaaatgtcaccatatcaatcggtaagacaatgtattcgaatttttctaagtctcaatgatggaaaatcagagatggaacatttcgattatcaaagaaatgatggttaccaaacaaaaatagatgctggatttgaaaatttggatctacaaaaagatgctgctaaaataatgctttatatgcaaaatgatattattagttttaataatagtagaaaataccagattactaaaagagaatttcagccgtgtgtccctgttatgttaattttacatgtagaggagataaaaaagtagttgtaagagaataaaaacttttgaatattctcgagaagttgaaacttttgataaaaaatatatatctatgtcctatatctaaattatattaaatatcttcataatacaaaaacacaatttctaagaaagatatacaaagaaatatatctgatttacaaaattatatgcaggaaaaaattgatatattaaatagacatgtttttcaaaaatataaatggttagagaattactatcgaaaaaatcgcttatgaggttagaacccccataaacttattattcatttttaaattcagtagtaacatctttctcataattacactttggattaggacaccgcaaaataatgcgaccgtcaacacatgtatcaattttcagtttctcgccgcatattgggcaaatcgttggtacatccataatttccctgttttctttttcatcaaaatgagacatcctattttctcctgttatctaaataataagaaaaagaaaatcagaaaattgatttcctttttctcagttatgttttttacagattaaaaaatcttagcattatttagctgtaattgtatcaggtacagttactgtaacatatctgtataatgtttccattatcagatcatcaattactgaatagtaattacagtatttggtaaatctacctcaacatctgtataaacatttgtgtctggaacctgaacctttacaaccagttttgtaactgtaaagttattctgacgagcaattgtctcgtttgtaatatctacatttgtattgatggtaaatgtataagaagaatcagcctttccgtaaggaagttctttgacaattacaccattaactggaaatatgggcggtattttccgcggaagtgttggaaatattggatttgtaaacagcagttgatgcaaaattattgctacaagtaacacgtaatcaacatataagaaactggcaagtgacaaaaatgaggaaccacttataatgtagaatatcaaatttcgacaacacaacaaaacggaatatgtaatacaaaaagtgccagcattcagcaataaatcgaatactgacacttttgagtgatcgcaagtaaagttttccgttcctcggaatattcttttttagttcttccgcaagaccttcctttatatctctaccaggatttgatatccgaccgcaaacatttctttttcaaattcttctacggaaagattcagtttctgggctccccgtgcaactccataatccccctcctgtacggacacaaatacctctgttttacgaccttttgcaagacccttttcaagaccttccgcaagtccttcctcccggccttcctcgcggaggacatcttcatatttcttttcatcaaattcagtaagacacatatcacacacctccctgcgatgctgttccaaaaaatctctgagaatattttcctctatgcattccctgacagtaagatcaatggcttcttttaattccatggaatcccggtatcttttgatttttgcaacaaagaccgcggattcatataaaacgtggcagctgtccatgatggactgatttttcccgctgtttatgttaatcattgtggctgtccattcatattcaccagctccggtatctgtttcaaaggcatccgataaccgcagaatccttctttcttcttccatatctttttcgcttccgttgtaaaatacaatgtaatgaggacgcggaaaatggaattaaattttctgattatacgtcaactcttaagtatattttggtttttaatattttctgtctctatatcttcgttataacatcaaccttaaaaaatcactgggtaaataatgcaaaatatctgctggatattttggaagatgaataaaatggactatccgctgtttaaacgatgctcatctacagattctctcttcatttcatatgccaccaactgtttcaaaattttccgttatacctctactgggatttgatattctgctgatactaaattttagtttgcactatttctcttttacataaaatatttttagttgtcgcaaatcataaattaaatcatcatatattccgtacattatcccttcaatgaatggaatcaaggtataaactgcaacaaatataaatatacaatacaccaataataatatagcattactagctcctacattagatgaagtaaatagttgttgaataatgtatattgtgattggtacaattaatacactgagagctttaacaggttttttgagtggtaaaaacagattagcatcccgtttggcttgattagcttcatcaatcaataagtcaattttttgagtggtaattggcaaattattttctttaaataaatcaagtaaaatattcattctgtctgttgaatattccttactattttatattaatacagacagatctctggtatctgacaaatttttgtgcaaaaaaattattgtgaatatgctaccaataagtaatgtaatttcaaatgccaactcacattttgctattataaaacaacaacctattatactcatcaaaaacaatattattacagttattttttgataaaacggtaactttcgaaaagtaatggttgattttaactgtttatgtttctttttataactaagcataaaagtactaaatctcatgttgtgtccacctcataaaaaaaaaagaggttgcttcgacagcctctttttataaaatgtaattattttaatgtaattgcccgagaattagagtttccgggtttatggggtcagccccataaattctaaacttacatggtcttattttaaaattaggtgatatccctcctgaaataagactacaacttcgtgcggtcgcgctgctgagaatctgcagttaattccgattcggcacaatcgcgtaggcggatacatcaaaaataaaatgcggttagcacctaccacaatgtgccgttggaccaaaatttaccttatacattcaattttacacctctacagggatttgatatccggccgcagacatttctttttcaaattcttctacggaaagattcagtttctgagctccccgcacaactccataatcaccttcctgtacggacataaatacttcttttttacgaccttctgcaagtccttcctcccggccttcctcgcggagaacatcttcatatttcttttcatcaaattcagtaagacacatatcacacacctccctgcgatgctgttccaaaaaatctctgagaatattttcctctatgcattccctgacggcaagatcaatggcttcttttaattccatggaatcccggtatcttttgatctttgcaacaaagaccgcgtattcatataaaacgtggcaactgtccatgatggactgattttttccactgtttatgttgatcattgtggctgtccattcatattcaccagctccggtatctgtttcaaaggcatccgataaccgcagagtccttcgttcttcttccatatctttttcgcttccattgtaaaatacaatgtagtgggggcatggaattttcaacagatgcttgctgtacagccgctcggatcggtgaatcagtttccggtacagatccgcataatacaaaaatccacggagcggcacaatcacccgtgaatcgaaatggaggtacataatgaagaaaattaaccttcgggagctttatcctgatgtttatacaacagactttttggtagatgtgacagaggaagtaatggagactattcgggcagctgaacgcgtcctatattatagaaccagaatcaaagacgcgaatggtaagctcgtagctatctacgcaaaaacacctgaagaactatacaacaaagaaacgtttgcgttggaacagataaacttgtattgttcgagacaaagaactataatgtactctgtgaaggtgcataatggattatatgacactaaaagaggccgccgaaaaatggggcgtgacacctcgtagagtaaattactattgcgctgctgggcgtatccccggcgctgtaaagatggctggtgtttggctgatcccaaagaacgcagaaaagccgattgacggaaggacaaaacaagggaaggggttgcaccatgaataaaatcctgattatagatgatgacagagaactgtgcgctttgattaaacgtagcgtacaagcagaaaacatagaagctgatttttgtaataccggaaaagagggcttacaaaaattaagagagcaggagtatcagcttgtggtgctggatgtgatgatgcctggtatggatggctttgaaacgctggaagaaatccgcaaagagaacagtctgccgattttgatgttcacatctaaaaatgacagcatttctaaagtacggggcttacgagccggggcggacgattatcttacaaaaccgtttgatatggatgaactgattgcccgtattgcgtctcttattcgccgctacactcgttttaatcatcaagccggagctgtgcaaaaactggattttgatggattgcaaattgaccttgaaaatcgttctgttacgacggaaaacggcacttttgaacttccaccaaaggaatttgatctgctcctgtactgtgcaaagcatcaagggaaaattttgacaaaacagcagatttatgaggaagtttggggcgaagaatatttctatgatgacagtaacattatggcgattatcagtcggcttcgtaaaaaattagaagtcaatccttcaagcccaaagtatatacaaacggtcaaagggattggctaccggtttaataaggaggtgtagtcagtatggaaatcattgtattcttgtccattgtgattgctgttggggctgtattgacttccatcgttctcgttcggcgtgtaaaaaaacaaatagcagaaatgaccgatgtgctggttgatgtgaaaaacggaaatggcaaccggcgtattctatctgcaacaaatgaactgacagcacctcttgcctatgaaatcaatgagatcgttgtggcctatgaaagcagactttcaactgtacggcagacagaagaaaccaaccgccagcttatgacgagcctttcccatgacgtgcgaacgccccttactactctgattgggtatcttgacgctgcacacaaaggactggtcacaggaaaagaccgggatgattatattgaaaccgcccgccggaaagcccatgatctaaaagaatatattgatgtactctttgactggttcaagttaaattcaaacgagtttgctttggagatccagagcgttgaggccgcagagctgacaagaaatatcctcattgactggataccgatttttgaggataaacaggttgagtatgacatcgatattcccgaacagcctgtccgggtaagattggatatggatagctatatgaggatcatcaataaccttattcaaaatgtaatcgctcatagccatgcagacaaaattaaaatttccctatcgaagaaggaaaacagcatggagctgttgctggcggataatggagtgggaattgagaaggaagatttgaaacacatttttgaacggctctataagtgtgacaaaggacggtctgaaaaaggaagcggtcttggtctttctattgtccatcagcttgcagaaaagatgggtgggagtataacagttgaaagtttgccgggaaaaggaactgaatttatgttgctttttcctttggagagttaagcgggttcccgtctttatggcgggagcctttgtcattttactggatttcaaattgcaaggttaatgcaaggttgcggcaaggttaatgcaaggttggcatgatagaataccttgcagaacaggaggttttgaatatggatacaaattatatcattgaaacaaaaaacctgacgaagcaatacggctcacaaaagagtgtggttgacttaaatatccatgtgaagcgtgggagaatttatggtctgctgggcagaaacggagccggaaaaaccactaccatgaaaatgctgttgggcttaacgaagcctacttccggtgaggtcaaaatctggggaaagtctttacaggggaatgaaaagaagttgctgccccgtattggcagtctgatcgagtcccccggcttttatcccaacctgaccggcacagagaacctgcgtatctttgctaccctgcggggcgtaccaaacaatcatgccatcaaagatgctctggatctggtaggactgccctacaaagataaaaagctcttttcacagtattctcttggtatgaagcagcggcttgccatcgcccttgccgttatgcacgatccggaacttttaattttggatgagccgatcaacggtctcgatcccatcggtattgcagaagtacgctcctttattcgggagctttgcgacgcaagaggaaaaacaattttgatttccagtcacattctttcggagatttccttgctggctgacgatattggaattatcgattacggcgcgttgctggaagaagaaagccttgctgagctggagcaaaaaagcagtaagcatatccgttttacgctctctgatactgcacaggcggcaagaattttggaacgcaatttccatgaaaaccatttctccatacaggacgaccacaatctgcgcctgcacaacctggatctgcctgtggggaaaattgtaactgcctttgtagaaaacggattggaggtatcggaggtgcatacttgtgaagaaagtcttgaagattacttcaagcgtgtgacagggggagaaggaattgcttaaactaatcaaatgcgaatttttgaaattaaaacggaagaaatttattccgctgattattttggctgcgttcctgtttccaatcccgctgacttatctgatgacaacgccctctatgatggagcgatatacggatcgggcagatgctttcgatggactatttaacatggtgttgggatatggtatccagtttttactgccctgcattatcggagtgattgccgctattctgttttttatggaacgcgacaacgatacattcaaaaatctgcgtacaattcccgtaaccagcacgcaaatggtgcttgcaaaaattattgtcctgtttctctttggaattgttttttgtgtggcttctaccattgcaacaattctttgcggatttggaacattggaagtttatggaataggctataaattgtttttagcggttgaaacaggaattttcattacggcaggaacactcccgttgattgtccttgttgtctttttcagtaagacctatgttttttccattttgttgtgtgtcttttacagcgttctgaacatgagtgctacggcattgtttgacacactgcctaaaactatgttatggcttctgcccacgccactgactacattttggagtgcgggagatatggcggctcatggaataaaaatggacttggagcaaatgacagggctaattccctcaacatttcaagttgtattcattcttgggatcatggcattggtttcgttcttactgattgacagattatataagcagaggggggaataaacatggttcgcattgtaaaaacagaattttataaattgaaaaggtatcatatcctttgggcgggcgttgcactcatgctcctatccgtcctgctgaccttgtttacctctatggcgaatgatggttccgtttgggatttcgcctatcttacagaacaggtcatcaaaaacaatatgtccatgatttttccgatgtgtatcagcctaattgctggatatatgatttctcgtgagcagacggatgacacattgaaaaatattctgactgtgccgatctcttttaagaaactgttgaccggaaaattgattgtgtgcggcgtattgtctattattttcgggctgatatgcagtctgtttacaatcatagcagaaatgattgtgggatttcccggctttgagatttccttagctctaaaagcagccttgcagattactgcggttaatttctttttatatcttgcggttctgccgattatcgctcttacttgtcggagggcaggcagctttttagtcggtgtaatcattgcttttgtctatggatatggagggatgtttgccgcaggaaatatgacattagcaaacctttatccgattaccgcaagtctcggaatggtaggctaccgtagctatgataccgcagtcaactggaatattggaacctgttcttgcagtcttgcgcttgctgtcgttatttctgccatcttgattttgtgcatgaaagaacgagaagcaacccaaacaaagaaaaaggccaaaaaggtagctccaaagaaaggctggtgatgattttatgaagaaaatagttttagcattaacattcgtccttgtgggaagttttatgcttgttggctgttcaaaagatgaaattctcaatcattacaataacattgttcagtctgcgggctccatagaactgacagggaaatcgtcactgcaaggggaaaaagaaaaaggaattgatgattatacagggacttatacggctgattatgcgaacttttcaggtacagagtatttgttcggaggaacttccataaagagagaagccggtaaggagctgtccattgattgcaccttggagattacggaaggtactgcaaaagtattttggatttctggatctgatgaagcagtcacgttgattgaagcaaccggaacttatagtgacacaattacacttcctgatggtggaaattatattggcattgaatgtgagaatttcactggaaacattgaattaaatattgaataatactctgccggacgacggcaaaagaaaaaagccgtcgtagagcagacaatttgacacgcccatttgaaacggcggctttgcaaatttcaaatctactttcaaagaatgggatatcaatatcaaaacaggcagatctggtattttctattgacccatatacatatcaactaacggtgtcgggaaatgcagatagagatacactatcgcagatagaaaaattgctgaatgaaggggataatgcgaaaaatatatggacacatgcgtggatttgtatgcatgatgcagataatgaaattgttaattcgcaggcaaatatgacaaaggcaaaccaatattctttatggcatgaagtgtatgagacaaccgggtatgatgcacgcaatgcgatatataaaaatggtacttttattgcagaggatggtacagatttactggcattgtttaaggaaaaatctaaaaatggtgcagggtatgaactttattctaagagatggctgcaatatgctaaaaatggctggaagaaagaaaatgatttggtattaaaaataggctttgacagcagtggattgtatgatatagggcaggaaaaaggatatggagcagcacagaatatgtggatgaaaggtgttagccaaagtatgtttgaagctagagtgtgattaatgggaatctctttttcaaatataggaacagttggaagggaacagctaattacttctggtagtaatggagaaccaaactggtcttatattccatcgaaaggaaaaagtacaaaaaaagcgaataacagaacctatcagtttgcagacgaaaaaaccaaaaagcagattgcttatatgagtggttattaccttcagacagtgccgcagagtgtcaaggcagcatggcaggaaacattggaagaaactggttttaatccatttcagacggatgtaaccagtatattaacgcagctatcggtagagcaggattttctgacaggtggtgatgacaatatttttggtgaaacgaaagaaagttatttagcagctatcgacaaagtattggagagaatagaaaatccgctggcagccgttacagatgaaagggcagcatatctgcaacaggaaaaagaattttataccgtgttggcatctaaaataagagaataaaatgccgggaggaatttaaaaaatgattggaagtataggagcggagagccgttattcaacaggttataacaacctaaaaccaaatcggaaccagaataagtgggctgacactttggctcagacggtggataaggaggatattagcagtagagcggatatcaatcgtgctaagaaaagtacagtgatggattcttatctggcactgtcaggaaaaacgataaatactttgaaacaggaatattcagagtacgaatccgaaaattatagaatcgtacccgataatgaagctgaatgttttgatatatacaataaagacggggagcgtttgggggcattttcctattctgatataaaaataagacaggatgaaacaacaggaaagcagtttttgatttctgagcatggaacgatgagttacgatgccctggtattagatgatgaattaaaagatgcattgcagaatgtaatggataaagattcgctggatgtggagactttgcagggatttacattaaatacacattcaggtaccggcatccagtatttagtaaaagacggtgaagaaggcagaggtggcaaggttcttctgcaaaatgaagcggatcggaagaggtatgaagaattagcggagatgtattttgacaaataccctaatttaattgagagtcgggaagaaggttttatctgggctgatttagagattagaggaatggcaaaacggacagatcagggaattatatccataggagctgatggaatgtcatacagtgacaatgaaaattataaaaacaattggagtgtccggttttctggttctatgtatgaaaagctgtatgaatggcttcagaataacaaggatagcatggaggaaatccataaattttctacatggcaaaaggtttttgacgaaattggtggaacgtatgaaagagtctggtcgaaagaagaactggatcagggatatttgaataattgaaagaggggatcatcacggtattggattgttaaatgtaaaagcagttgtggataaatatggcggtgatatggtgctttcctgcgatgaaaatgaatttaaggcagtggtcatcttgtaaagagatggtctttgtgtgcgtaatatggtcgtttgatgatatgggactgggagaacaggttattttatccgataaagaaagcaaaggaggttactatgagtaatacaattaatgtgaactatatgacacgggcttacaatcagtaccagcagaaaaatgcggctaaagatcaggagaaggaagatacaaggtttgcggatagtgtaagagaaaagagcgaagctagtggaagtatagtgggcaattcaaaaataggttctgtgtctgctaaagatatgacgatggtggaatacaagcagtacatttacaataaaatatctcaaattccaatgcaccccacaagagcaggcgagtcaatatctgttacaatttcagaggcgggttttgaagcaatgaagaatgatccagagtatgaagcatgggtattaaatgatttgcaagtgggttggtcacaaccagataaatggtccggtatatgtggaggagcgttttctacaatatattatggagcatcaaaagaagaatgtcatgctgagatgtggagtgccggttataacaatgggaatggtgaaaagatttttaatgataagtcaaaaaatagtttttgggagcgcagaatagaaaataaaaatagaatagaaaatcaggtaaagcaacaacagaaaaaaaagcggattcagaaaaaacaagcggaaagaacagcttatgaagaatatgtgcaaaataaaaggttatcagctcaggatgccagaactcgattggtggctgagagtagttcgtctgctaagactgtcacaataagtcaggcagtagcttcttatgaggcaaattttacaatggcagtaagcgtatcgaacaaaacccaatagcctgcaaataaaaaatcaaggctaaatagaaaggagagatgcagtatgggaattaatggagtatcatcgtatgccaatacatacacatacggaaatgtaaaaaatgaaaatgtaaagccatcaaagaatagtgaaaagaattattatgcaggatacactatgaattcagccaataagtttaaaaatgtatcagactattcaaaatatttgactaacaagtataaatgtttgactccatgcaaaaatgcttctgtattgattgacggaagtgtaatgcgaaaggcatgtggagatgaaaaaactgcgaaatggcttgaggaaaatttagcaattatgccagatgttatacgaaatgcacagaaggcggcaataagtcatggtagtaaactgatatcagtggagtttaagtttacgaataatggaaccgaaatgacaacctgtggcatttttggagagactggtacggattcagaaattgacaaatggctggagagaatgaaagaggataaagaaaaagaagataaaaaaacagaaaatatgattgctatagaagcgacaactagaaataaggtaggttttgatacatatgcatagtatcaatttctataattttgaagaaagaaaagattacaaacaaggtattgaaggtagtggagagaattgcccagaatgaagtggaaaaacagttcttggcaggacggcagagtattcagcaatttatcaccagccgaaaggaccgaagaaaagggaaaactaggtcagaataatgaaatattttgtggagtgttgtggttgtgattatcgtaatggcaaaacaaaaggagttaatatgggattaggcgttgaaaattcagttaaatccgggcgggaatctgacctatcaggattacgcaagtgatatccggaaaattttagcatataaccggacacagcacaaagatattatgtctgagttgaatgtacagtttgttatagcagacggtacaattcagataaactgattggaggaatagaagtatgcacattggttttggtcagaataccgtatcttcattgtacggtcatcaaaaaggcgatcatatgaaaactatagagctttctcataaaaagcataaggcaaatgaatcgcaagaaaaaatgaccgtaacatccggcaaggacgcatgccggaggatagggcattcagatgaagccgatggggaaaatcaggaaaacgcatatatacatgataggtttgccttagatgctggttacgcaaattatattagagaaacagtgcctaaaactacttggtcaaaggattatcttcaagaattatgggatgaagagactaaatatttaaagagtatccgtgaaagtaaaaatggatatggtttcgatgatattggaatgggagctgcatatgcctattctactatgtatcaaaaaattgtagaaggatataggaatggaacaagagaagtgtatgtatgcgatgattcagagagtggaaaaagacgtttgctgtcaatggatgaagaattggaaaagctaaataaaggttttgaggaactgataaaatgggacaaaatggttgccaaaagtcaaaagcaaaatgcagaaaataagcagaaatttcagaatacaaaattggatgaatcgtttgatgcctttgatataaatcaggcatgtgactatattcaagattcttatttagagttccgttcactttatctggagcaatatgaaagaacgggaggaaatatagatataaagtctttgttttcttatgttttaagaagcggaaatcaggatatgcataaatattgtgaatttctgtttgaaaaaattggttttattgtttaatgcgggcattaaaatgtttgagaaatattgaaataataaggaaaaagcatgagatggcggttgcaaagcaacagagtgaagcgtggagaaaagcgttagatggagtgccggatagtttaagaatgttgttggaaataaataatactgaaaatgtgccggaatattcagaaaaacaaaaaaagcaatataacgatgcaatcaaggcttatgatcataccggtaacggtgtaagctggtcgcagtttgaatggaaaacttacgatacacagatgacagtcacatttgaggattcggtgaaagttgaaagcatttcaaaaaatggaaagtttaagtgtattatggagccatatccgggtaatgaattagatttttctggaagtaaccagttttccgtatcagacaaggttatccgtggcggtgtgaaaatccagaaacgagatttagaaacgggcgatacaaagccacaaggaagtgctaccttgaaagatactgcctttgacatcatttccttaaataataattctgtattggttgagggcaaactatataagaaaaatgaagtggtaaagacaatccatacggatattgagggtatcgcttctacttctgccgaccttttaccttatggaaacttccgtatcgttgagagtgaagctccaaacggatatttgacagacggtgcaaaaccgattgactttgcaatcacagaaaacggaaaaattgtggacttaactgacgaagcccattctatctataatcagattaagcgtggcgatattgagggcgtgaaaatcggtgcaggcacacacaagcgtcttgctgatgttccctttaggatcacaagcaagacaacgggcgaaaatcatgttgtggtaactgatgataacgggcagttctccacttcttctgaatgggcttcacataagcacaatactaacgcaggcaagacaagcgaggacggtgtatggtttggaacttctgaaccagacgacagcaagggtgcgttaccttatgatacctacatcattgaagaattaaaatgtgaaagcaacaaaggttttgaacttatcccaccttttgaaatcgtagtatcaagaaataatcttgtgattgatttagggactttgactgatgaatacgaaaaagaaatctctatccataccacatcgaccaacaaggacggcgaaaaaactatccttgcaggaaaagaagttacaatcgttgataccgtcaaattagacggacttacaaaaggcacaaaatatcagctcaaaggctggcagatgttaaaggaagaaaacgctgaacttgtcattgacggaaagcgtgtagaaaatgactatacctttattgctgatgatgaagctatgaaagtggaaattacttatacattcaatgcgtccgagcttggcggtaaaaatctggtaacattcgaggaattatacgatttgagcaatccagaagaacccgtaaaagttgcggaacataaagacattgaggacgacggacagacggtacttatcacagagcgtatcatcaaaattcatacgactgctaccgataaggacggcaacaaagagcttgaagctggaaaagaggtaacaatcattgataccataaccttagagggcttagaagtcggcacacagtacaaacttgtaggctggcagatgttgaaagaagaaaatgcagagcttcttatcaatggaaaacgtgtggaaagtgattacacctttaccgcagacagcgaaactatgaaagcggaagttgcctttacctttgacgctacttctcttgacggcaaacagcttgtaacttttgaagaattgtacgatttaagcaatccagacgagccgaagaaagttaccgagcataaagacattgacaacgagggacagacgattacctttaaggaaaaacccgaagtcccagaagaaccagagaaacccaaaacaccacagacaccagatacaccgcataaaacagacagtccaaaaacgggcgataacacgaacctttacggactgcttgcattattactaacttctggtgctggactggcaggtatcttcttctacaaacgccgtcaaacgaagaaatcataaggcggtaacgatatgagaaaagaaaaatcacgctctccgccgataccgtgtcggcagacttacgcttattctggcttgtctgctacttacctgcaagaacacggatagtcaagggtgcgtaagcattgattttaccctttactatctgtgggattgctggtacttccttaaccgccagaataagaaatcacaatcaaaaaacttatcaaatatagaaagaaacgaggtaaaacactatggaaatgaaatatgtcgtgccagatatggcacagtcttttggaactcttgaatttgcaggcgaaagcgaccatgtttttgagagagataaagataaccgcagatttttcgcaagaagaagctacaacctttattcagatgtacagagaggggaaaatgttgtggtagaaattcccgtgcaggctggcgaaaagcatttcaagtatgagcagaaagtaaaacttgtcaatccgaagttatacggcagaggttacgcaatcggggatatgggacataccgattatgtgttgcttgctgatgatattgtagcagttgaagaaaagtaaaggagtggaaacattatgagattatcaaacgggtttgtcattgacaaagagaaaacatttggagaattaaaatttacagcggtgcgtgatgtgttcttgcagaatgaggacgggacaccgagtacccagcttaaaaagcgtatctatgatttgaagtgcagtttgcatggtggaattatccccgtgtccgtaccgccagaagtaccagtaagggaatttccgtacaatgcagttgtggagcttgtcaatccagtagcagatacggtatcacgaaaaacctatacgggtgcagatgtggactggtatgtaaaggcagaggatattgtgttgaagaataaaggcaatcaaaacgcaggcaatccacagaaccatgtaccgcaaggacagatgaaaaaataaatgtgagcccatatttttcttgtaacttatatatagaaccgatataattagttgaaaagttctgttttaagccatgtaaaactattttgacaagggaaaatggcaatgtcaaaggcttttgacagacaaaatagctatattcatatacaataaaggagaagattcaagatggatattggattacaaatcaaaaaatttagggaacaacaaaaaatttctcaagaagaactggctcttaaaatatttgtttcaagacaaacaatttctaactgggaaacaaataaaagttgtccagatgttaaaagtttaattactttatctaatatcttcaatgtgtctttagataattttataaaagaagatataaaggagatgagggagattgtagaaaaagcaactattaaaaagtttaatgtgataagtgtagttttcctaattgaattgatagtcgtagccataagtgcctatcctttatttagtattaagggaaatataggaattattatttggttatgcttgtttgcaataacgctctatacggcaagtaagattgaaaaattcaaaaagagccatgacattcaaacctataaagaaattttggcatttattgacggaaagcaattaacgcatgatgaaacacaacaagaaataggaaaaagaaattatcaaaaaatcatatttgcattcattgcaggtgtaatcgcacttattatatgttttgttgtaattttaatttgtcagcacttaatttaaaagggaggaaaaatcatggaattttggcttattatgattgcctttatagttatgggtggaagttgctcattagcaggtacttggtgggatagaaaaaataaaaaagataaaaaagaagaaaagaaacaataaaatttacactttattgttgattaagcagttagtcttaggattgactgcttttttcatacctagaaaggattgatttatgcgtatgatttggaacaaaggacaccgtatcagagccagcgacaagcaccttgtctaccacttttccatagggacgcttctgtttgtattcatggcggttcttctgctactgaacatcaaacagctcatgcgtaccgactgggaacatttcagcttgttagaaaacggcttgacgctttccccttacaacttcataactgtgctgatagcgactggtgtttgtgcattggtcgcttttctgtattaccgcttctgttacgacagtttcaagaagctattgcaccgtcaaaagctggcacgaatgatactggaaaataagtggtatgaagccgataccgtacaagacagcggtttttttactgacctgcaaagcagatcaagggaaaaaatcgtctggtttccaaagatttattatcaaatggaaaagggattgctccatatccgctgtgaaatcacgttaggaaaatatcaagaccagcttttacggttagaggataaattggaaagtggcttgtattgcgagctgaccgacaagaccttacatgacggctatattgaatacaccctgctttatgacatgatagcaaaccgcattaccattgatgaagtatgggcagaaaacggctgtcttaggctgatgaaaaatcttgtgtgggaatatgacgcactccctcacgctttgattgctggtgggactggtggcggtaaaacttattttctgctgacgctcattgaagccttactgcataccaacgctgtcctttacattttagacccaaagaacagcgaccttgcagacttgggaacagtcatgcctaatgtctatcacaccaaagaagaaatgattgaatgcgtcaatgccttttatgagggcatggtacggcgaagtgaggaaatgaagcaacacccgaactataagacgggcgaaaactacgcctatctgggacttccaccctgctttcttatctttgatgaatatgtggcgttttttgaaatgttggggacaaaagaaagcgtgagcttacttagccagttaaagaaaatcgttatgttagggcgacaagcaggttatttccttattgttgcctgccagcgtccagacgcaaagtatttttcagatggtatcagagataacttcaatttccgtgtgggacttgggcgtatcagcgaattaggttacggtatgctgtttggttcagatgtgaaaaagcttcctaagtcaaagaaattattacagtttactttagatgacggaacaggcacagatcgcactattttaagcggaatccacgcttactatgagccggaagaacttgttggcaagacactgatcgccatcacaaatcttccaccacgtaagatgatgggcattgaatcctgcggtatgttactttccgcagtcaataaccttaaggattccgaggatgaagaacttcatcttcttatggttgataaccacattccagcaggtgcaaagctgtactaaaaacgagatgtaccttattggtggaaatttgtaaaattacagaaatacgccaattttacgccaaacgacgcagagtttgatgtaagaaaacaatataatgatgtggaatcagacgatatgacatagaagccccattggatagagaaatctgtctgatggggttttattgtatatctgtgccactttcgaataagtggctggcaaaactatgacgacatgcatgagaggaaacatgacgggtaatgccggcgagtttagcacttttcttaaagaactggttaacactggctatatcaagatatccaccggtccaggaacttggaaaaaggatatctttagggcgaccacatttataccaatactcagtgagaaggtctaaatttttttgagacagaatcgtatacctgtcaattctgcctttggtttcacgaacatgaattgtcatgttggtacgggaaatgtcatcataatggagatgaacgacctccgatacacgtaatccggaagaatacatagttgcaataatcgctttatgtttcagattcggagtggcgtcaatgattgcatttatttcatcgcgggatagaacagcaggaagattgcgctctcttttcatagctggaacagtgtcatcatcccagacagtcttcagcatctttttatataagaactttattgcagaccgatagtgattgtgagtttcaggagaccttccttccagacgtttggcagtaagaaaactttccgcatctttaagtgtaagatcagaaacattttttccaatccaacgaaggaagtaactgacatcagagcaatacagttgaatagttctttcacgcaggttacgtttttccgcttcattgcggatagattcaaaaatatctttatacataataaaacctccagaataagtagtgttaataattacatctacctattcggaagtgcattagcgtcataattccgattgcggaagagactggaaaatgttattcttatcataggcagtggagcttttttagttcagttgtttcgtgtggtaacttaataataacggattatggaaagtaattccactgctttttaataaaaataaaactgcgccacagccttggcaggccatcgcgcagcgattttgttcaatctaaatttatggaggtatatattatgagagtaatcatttcaatcattctaatggtaattgcagcgttggtcggttttttctttggtgctggaatgaacgaagcaatgggtggagcaatactactttcaatgattacaggttttgcttgcactattaatgctattgaaaagaacaagaaggactgacaactccctgttttgagaattgagaaaatcgatacttgtagatggaggtaatcaaaatgaaagaatatcaatatttgattggaaaaattattgtcgcagtggcaattatagttgccgcaatcattatagcgcaggctattggtggagctggagaaagtatccgtagtagcttgtggcaattaatggatgctcttcgataacttcctgtttttcaagctgtacatgaaaatgtatggctttattttataaaaacacattgacgattatctatgtatatgctaatctacactagataaatatcaatgcgaggtaaatgaaatggaactaacaaatgttgcattaatctgcaaggcacttggagattcaaacagattagaaatagtgcaaatgttgtcagatggcgaaaaatgtggatgcaggcttttggaaaaatttgaaattacacagccaaccctgtctcatcatatgaagatactggtggaatgtggattggtgaatgatcgcaaagaaggtaaatggcatcattactctttgaattgtgatactttattagaattcaagaattttattggcagtttgacatgtgagtcatgctgtgacaaaaaaagatagctgttgttagaggggaaatgctaagatgaagttttttcaaaagtatttatctgtgtgggtcattctatgcatgatcatcggtgtatccataggacatttttttccgatgatacccaatatattaaataagtttgaatatgcagggatatctattcctatggctgtattaatctggattatgatttatccaatgatgattaaggtggacttcaaaagtgtcaagtatatcagcaaaaatccgaaaggaaggtttctatgacagtaagagaaaaagcagaactgattgtaaaagatataaagaaagaacagggaacaaatccggttgttatttttaagcagattgcagagaaggaatatatcagcattcatggaccggaacaccatatattagatggtgcaagtttgctagtagcctacaaaaacgcaggtggagagatagacttagaacaggcattggacaggctgatgtcagaaggacttcggatgccgggagcaatgtgcggtttatggagaatatgcggagcaatcacatccattggcgctgcacttgcaatcatcgacggaacaggtccgctttcaacagatggaatatgggggaatcatatgcagtttacctcgaaagcaattggagaattaggagccataaacggaccaagatgctgcaagagagatgcaatgatagcatttaagaatggtattgattatgtggatgctcattatggagtaacattgcaatacgaacaaatgcaatgtggattcacagattttaatgagcagtgtataaaggagaggtgtccatttcatgagtaatgtaaaagtggcatttatttgtgtccataattcctgccgaagtcagattgctgaggcttttggaagacatctggcatcagatgtgtttcaaagttattcggcgggtacagaaacaaaaccacagattaaccaagatgctgtccgtattatgaaagaattatataatatagatatggaagcagatgggcagttcagtaagctggttagtgatattccaaatccggatattgcaatatcaatggggtgtaatgtgggatgtccatttataggaagaccgtttgatgataactggggacttgaagatccaacaggaaaaagtgatgaggaatttaagatagtcattgaaaaaatcagaaaagatattttgaaattaaaaaatggattggataagaggtagacagcatcagattccagcttgtccgtttcacaaataacttaataacaaacttacacagcactttagccacaggttagagtgcttttttcatgccttgaaaggaggtggtcaaagcacaacgcatcggggaaagcccgattaatcattacaacaggcattgcctgataatcatatagtaactataaacaaggacagagaggaattatagcctttataaagcaatggatgctttatttggtgtacctgttttcagctatttagtacttgatacaatgaatgttcatacactttagcacttgttatgaggtaactgtttaaagaaaaagtccaaaaatcaatgatttggggcttgaaattataggaaggaatggaaaaatttgatgaatacataaatggagtaagcacgaattatggaagtttggtagttccggtaagtcgtggatagtgtaaggaggactgctgcaaatagtgaaaaaaataactaattaaatctgtattgcaaaatactatacaacgtggtacattacagatagataggaggatatggactatggcagttaaaacagctaatgtaacagcacgtattcaaccggagatcaaagaacacgcagaggctatattagaaaagttggggattccggtatcagtatttattgacatggcatatagacaggttattatgagagatggagtccctttctcattagaaatcccgagtactttgacaactagagatgcattatcaaaagaggaatttgataccattatgcagactggtcttgcgcaggcaaaggcagatgactctttggcaatggatgatgcatttaaccagttaaaagcggagatttaatgtgtatggataaaaagtacgaagtagatcagttgcgagcattgatgaatatggattataaatcagagtaatgatgacttacgcccaacatgctcccaatttacgcccaaaagggaaaaagggtgtagaattagggtgaaatatgaaatgctgttgtataaaatataaagtaatataggtgcataaagggctataaaatagatttgttgatcttctcgacaatgaagatcattggtggcgtaaaggctgaaaatggcgtaagttctaagccttcagaagaggtaaaagtgggggcagccactgtaagagtagaatcggctgttttttgatatcaatggcaattctttcaatcccggtttatacacatgagtttgtaatgaacaatgtcccggcaactgtaattttgatgattggaattgcggcagtggttgtaatccttattttaagcccggtggagagcatcaacaagccgcttgatgatgaagagaaaaagtattatgcaagagtaacgcattgtatcgtagcattgcaggtatgtgttcttatcattttgttctgtttgggagtaaaggattatttttatgcaggatatagcagtattgttctggtggcggtgtttatggttatggggaaggttataatgaaaagatatatataacaatactctgtgtgtgaacctacatgatgaaatcaaaagttatataatattcctgattctgctccaaaattcccaattctgcaataacacttgaactttactgcaagacacggataatgattatgggataatatatgaaaaaattgatgacctgccgatatacacacagagtagactatgatatgaggaggtgaatgcaatgttatcaatagcaatatgcgatgatgaagaatatttccgaataaccgaaaagcagcttatattaaaatatatggcagggaaaaactgcgaatgtatgattgatatgtatgagtcaggaaaagaattattagcattaagatcagcaatttctcaatatcatattatttttcttgatgtgaatatggaagaaatagatggaatagagacagcaaaggaaataaggaaaataacaaaagatgtttttattgtttttgtgacggcttttattacatatgcgttggaaggatacaaggtggatgcagtaaggtatctcataaaggatcatgaaagccttgaaaaagcaatgacagagtgtatggatacaatccttgaaaaaatggattatgaagaaaacgaaatgacttttgattttcaggaggggaaaacaacaatcagtctggaaaatattctttatatagaaagcaatctgcatcgactgatattttacatggcgggtgaagatgcagttcattatacaatatatacgaaactggatgatgtagcagaatcactgcagaataaaggcttttgccggattcataaaagttatctggtaaatttgaaatatgtagaaagtgtggagcgttacagggctgtgctttcaaatggaaaaagtcttgcaatatcaaaggcgagatttttagatacaagaaacgaatttgcttgttacagaggtgaaatttaatggaaatgcatatttttggagtgctgtatacagtgctttttgtaatattgtgtgtgatgtttatcgggactttttcagaaaaaagagacctgtcgggtaaatggtgccgctatgctgtcatcggagctatgattttggcagactactttatttccgtaaaactggatggtgacattatactgaaagaaatagcaatcattgtgactggaacgctttttatgtgtttgtgtttcagacagcggtggataaaaacagcaatctttgttttgttatatcagggaatctgttttgtgacggattatatttctattataatgctgtctaaatgttttccgacaattacgatggaacgtttatcggaaccactgataaatgcaatgctaggaattttaagccagatgctgcaggtctgttttattatggtgctgcgaagatatgttgtaaaaaaatcctcggaaatgcttaccacattagaatgggtaagatttacaatctttccgatttatacaatcattgtcctgattgcacttctgacaaattttgaaattccggaaagtgatcatcagaaaaatatattgatctgtatcgcgtttgggttgctggtgatgaatattattgttttttgcctgatcaatgatatattgaagcgggaagtacagataacagagaaccgcttattgctggagcgggttaaaaatgaaaccggaatgtaccggacgatttcagaaaattatgataaacagaaaaaaagagaacatgagtataaaaaccagcttgcactcattgcagcgttagccagtgaaaacagagtagacgagatcaatcattatctgaagcaatacaatcatgaaatcatgcagcacacagatttcattgatacaaataatgtaattgtcaatgcaatattaaactcaaagtatcaggagacaagggaaaaaggcattgtatttgttgtaaaggtaaatgacctgtcggatttgagaataaaagatgaggatattgttctgatattgtcaaatttattaaataatgcgatagaagcatgtgagcagtgcgaaaaaccaatcataaaaatgaaatttgtaaaagaagaacatcagattgtcctgtctgttgcaaatacattttcagtcaccccggtaatcgttgggaaaagatacataacaacaaaaactaaggaagcagacagacatgggatcggactggaaaatataaaggaaaccgttggaaaatatgacggttcctgcgtgataaaacatgatgatgataattttaaggttgcaattttaatacataatcaggaaaagtagatgcgatttatagttgtatctacttttttatttccaattctgctttaaaatttccaattctgcaatggatatacagaattagacaggaaatgacgaataaaaagataaagtgaactggagatgatgaagtcatgacagaatatattgcaaatatgttgacaaagaacatgtatatggatggtctgattaaagaaagcgatgagagtatttattcatactccatacaacttattattgaaaagataataggattttcggctatttatatgatagcgttatttcaaggatatttttttgaaactgttttatttactatatctttatcaaatttaagaaagtgcacaggtgggtatcatgcaaacagttttagaagctgttttattggaacggtaagtatttatcttatatatataaaattgatatacccatatcttcttaataatatgaagataaatatgattatttttcttgtatcggcaatggttatttttgtattaggagcagtaaatcatcctggcatggattggaataaggaagaattcgaggaaaataagaaacttgccaggataacagtatttgtggaattgctagttgttattgcacttacatatctgggaatggcagaaaaatatattctgtttatgagctttggaatgatcttgtgtgcaattttattaacactgggaaaaataactggacaggaggtgaaatgtgatgagtaataatattaagaaagagttattaagcttaatgcaaaaagctgtaaaacttgaggtagagaagaatggaaatgaagcttctcgctattgcccggttattttgcatcagcctaaaagacctaaaaaactgaaataggtaatgaaaatattactgtgtaaatggaaggagaaaatgatgaaaaaaataagaatattaagtttggctatggtatgcagtatgctgttttgcacacctataatggcggcagaaataacaactactgaagatgctgtaattgagaataacccagaagtagttactgagtctttggagtcagttaagttagaagaaatgtctcctatgagtttatcgaaggaacaatatgatgtcttgtctgatgatgaaatccaaacatatggaacaactccagatgattatgaagaaaatgattcacctactacagcatttccatatagcaaggttgaaacattaacgactcaagtaaccagcaataatgatttatatcgtttaggaatgaaagcggcagggcttcattcagaaacagatgaagattggttttacacttcattaactgcgggtgaaacatattttgtagatttacgaaatgttggacgcagagattggtatatagaattatattatttgggtgaagatttagattcctcatatttttattcaacaaatcctgaatataatagtgtttataaaggagctgctgaaaaatacttttattttactgcaaaagataccggtaaattttacataaggatttgtagtggaaatgattgggtagattccatgtattatttcttctatgttggtcctgctatacaaacttttgatattgtagatatgccaacatatggaggggtaaatctttttggaactgcgtatcaaacttatacatgtgatttgagaaatgcgtttccatctacaacggcaataataaatattaatttatctgattccttctcaaaaggaacatgttcacacctgagtaaatatatgagtgcaggaggaagaacatattacaatacaccaggtgacaatgcaattaagggcataaccaatgcttcaataggtcaattatggacatttggagcaaaatgttcacaaaatacgcatagtggagtgcattggtcgggaagaattaatggaaagtttaagtgtattatggagccatatccgggtaatgaattagatttttacgattagtctataccatcggttcttttgttacaagtttacctctgaacagtaacaaacgatccagtaaaaataaataataaatttcaaaaaggtagaagctgccaaaaatatatggtataataaaaagtaatcataatagagacaaaccattttctccaaagtgctctttacgctatggagatatgtcattaaacaggaaaggggttgattaaatgtccaaccatcaggctaccgaacagatgctaggctatctgtatcaaatacggtatgcattagcattgctcctgaagaatgacaatcccgattatcaaattagcatcgagaaatttgatgatgttgcattcgataaagacggccaacctgtccagcttatccagcttaagcatcacattaagcaaaaggggaatctcacagatagcagtgctgatttatggcgaacactaaaagtatggatagattccctggcacaaaaaccagaattactagatagcactgaatttttgattattacaaccgcaattgcacctaaagattcggccgccgggtatttgaggcaaaatgaccgagatccaaatatagcatatacaaaactgaaagatgtttgcaagcaatcccaaaatactgctcaccaaaaatactacgatgcatttttaagtgcagatcaattgactgttaagaaattatttgaacatatttatattgtcgatggtgcaagtaatattcttgatgtagaaaaaattgtaaaaaagcagattcgctatagttgtattcctaaatatgaaaatcttatatacgaacgattagagggctggtggtataaaaaggcaattgaggccctttgttctgaggatccaatttttgttacacaaaatcaagttcgttcgtttattgtttccgtaagtcaggaatactctgatgaaaatctgcccatagatgacttttttgacgttgatgatctacaagaaaatgctttgagcgaaagtgaaaaaatcctctatgaacagctgaaactgatttgtctgggaagtcatcgtatgcaaaatgcattaagagattattatcgcgcttttaaacaaagagctgcatgggtcagaaatgacctgttatatgtaaacgaacttgagaaatatgagaagcgtttaattgatgaatgggaccatgcctttggtgaaatgcaagatgatctggctgaaattaaatctttaactgaagaagagaaagccaaagcagggcgtaagttgttatctgatattgaaaaaaaagatattcgtattagacccaaatgcgaagaagcttttgttatgagaggcagctatcatatgctcgccaacaaactaaaagtaggatggcatgtagattttttcgagcgactgaaaggtctgctttgtacataaaggggggcgatttatgtgaacaaatgggatatgcgtacacatgaagtcgcataccttcttaatccagctttttgcggaagaattttatattcaactatcaaaacttataatgaaatattaaatagggcatttccatttccgttgatatacttagttttaccactcgtactgcacaaacaaacgcgcattaacattagtagtcgtacgcagttattggtctgggttcaaaaatattctcaactgttaattgattttcctcgaagaacaagagaattggttcccatttcaaacgaagcaatcgagtttcttcttcagactggtaaaattgtattaacaccgaacggagaactagaaattgttcccacttctcgcactctgagcaaaacaaagtatgcagattccgaagtaaaagaatgcctaacaaaagctgagcacgtagctaaatggtttgcttcagccgggaaaacagaaacaatatatattgtgttgggggtgaggccataatgcagatacttgaattagtgctttacggatacaatcagaaagttcgacacttgcctttcaaattgggacaagtaaatattattacgggaagatcaaaatccggtaaatctgcggttggagatattattgattattgcctaggcggtaattcttgcaatattgctgacggtgtagttcgcgaaaatgtggcgtggtatggccttctcctgcagtttgaaaaagaacgagtgtttgttgcccgaaaaaatcctgacaagggccaacagacaactacaacgtgctatattgaagtaggtgctagtttagaggttccggaacagtgtaatttctcgccaaacaccaatgtctctggaattgaagaagcattaactcgaagaattggtatatcagaaaatcttaatacaccgcctgaaggacagagcagactgcccttagccgccaatatccggcattcattgtactattgttttcagggacaggatgaaattgcagcaaaaaactttttgtttcaccaccaatctgaagattttattacccaagcaatcaaagacacgattccttattttttaggtgcagttagcgaagaagctcttgcgttagaaaacgaaagaaacattcttaaacggaaattgaagatcgaaaagcgaaagctcgaagaaaatcgttatttaatgggaggaggctcagagagggcaatcgcgcttataggcgaagctcgcagagttggacttatagatccagcaatgcagatagattatcaagattatcaggaaatgtacttaaccctgcaaaaagcaatgaattgggttccaaatcaagtacaacctagtaatggcatggaccgcttgacttttttgcagagcaaatttcaagagtgtcaaagtgactacgatgaaattggaattactatcgacaatgcgaaaagatttatcggagaaagcacaggatattcaagtgaagcagaacatcaaaaagtgcgtcttgagtctatagggctttttgagcaactggactttaatcccggaaagtgtccattatgctcagggacattagaacatccactccctagtgttgaaatgataaaagcctctattgccaatctggataaatcaatatcaaatgtaacacgtgaacaaccaaagctccgctcttttatttctgaattagagcaggaacgagaaaaaaaactagaagaaatcaaagggttacaatctgaaattgatggaatataccagcaagaagacgaacgtacacacctaagagacataaacgctcgacgaggcaaagtaattggaagaatcagcttgtggattgaaagtgtagaaaatgatacagagtctgataaacaagagcaaattattaaaagcattgaagatagaatccaagaaattgacgaaattcttgatgcagattccgtagaggatcgcaagcaatctgcgctttctcgtatacaagaaaatatgactaaatgggccaaagaactggagcttgaacactgtgatagtccataccggcttgacctcaataaggtaactgtcgtagtagacaagccggacagacctgtaccacttaagcaattaggcagtggttcgaactgggttggcgttcatctaattgcttattttgctttgcagtattacttcataggtacaaatcgcccggttccaagctttctgttttttgatcaaccctcgcaggtttattttccatccgagcttgatgaaaaaaatatagattggaacgaagtcaataaaatgtatcggtttatagttgatcgaaccagtgaacttgaggggaaattacaagttattatcgtcgatcacgctgacctcaacaacgcttctttccgagaatatatttgcgaaaattggtggccgattgacaaaaatcttgtaccaaacgattggtacaaaaaagactaaaaacagaaatcccaattcatcaaaggtaagcgcctagtttcagggtggatttaaaatcatcacaaaatttgccataattatagatgatagatgccagccgttcttaaatgtggcacaaggagaaacgctctctaacaagctggttcgtgctgggcgagctatgcaggcaggcgtttatttcgttacacaatcctctggcgacgtatcaaaggaaagtctgaaaaacaatatcggtttgaagtttgcctttcgtagtaccgacatcaacgagataaaacagaccttagaatttttcggcattgacaaggacgacgaaaacaaccagaaacgcttgcgtgatttagagaacggacaatgcttattgcaggacttatacgggcgtgtcggtgtggtgcagatacaccccgtctttgaagaactgctacacgcctttgataccagaccgcccgtgcagagaaatgaggtggagtgatgaaagaaaggataaaaggtgcgttcacaaaaaagaagatttttcactttctcaaaatggctctgtttgtcgtggtactctcccttatcctgctttcacttctggggacggtggctcatgcgacggggctcgtggacgataccataaacgcagaaaatctttactcaaaatatccgctatcgaattaccagcttgatttttatgtagataatagctggtcgtggcttccgtggaactggctggacggtatcggaaaatcggtgcagtacgggctttactgtattaccaactttgtctggacgataagcctttatttaagcaatgccacgggctatgtggtgcaggaagcctataaacttgattttatcaacgatatggcagacagtatcggaaagagcatacagacccttgcaggtgttaccgagaatggcttcgggagtacgggattttatgtaggttctctattactgataattttaatcattggtatttatgttgcctatacgggattgataaaaagagaaaccagcaaagcggttcaagcagttatcaattttcttgtggtgttcgtgctgtcggcttcttttattgcctatgcccccgactacatcaagaagataaatgaattttcatcagacatcagtaccgcttcacttgacttgggaacaaaaatcatgctccccaactctgacagcgagggcaaggacagcgtggacttgatacgggacagcttattttctattcaagtggaacagccgtggctacttctgcaattcggtaacagcaatgcagaggaaatcgggacagaccgtgtggacgctctcgtatcggcaagtccagaggacgaggacgggaaaaccagagaagaagttgtgaaaacagaaatcgaggacaatgacaacaacaatctgacgataccgcaggtcgtgaaccgtttaggcatggtgttcttcctattcatttttaatataggtatcacaatctttgtattcttactgacggggataatgatgttaagccagatactttttattatcttttcaatgtttttacctatcagttttcttctttccatgatacccagtcaagaaaatctggcaaagcaggcaatcgtgagggtgtttaataccataatgacacgggcaggaattacactcattgtaacggtggcgttcagtatttccagtatgttttataacatctccaaagattacccgttttttatggtggcgttcttacagatagtgtgtttcgcaggtatctttatcaagttaggcgacttaatgaatatgttctctttgaacgctggcgacagtcaaaacatgggacgcaggatattccgcagaccatatctgtttatgcgacatagagctagaagaatggagcgacgtatggctagagctgttagtcatggaagtatggttggagctggcacgggtgcagttacgggagctatgctatcgggtaatggttcttcaaggagtaatcctcaaaaagataaacgtacattttcacgaagcaacacttcttccagttttggaaatcgtgcaggctcaaaggtgggtgctgtcttagatacaaaaaataaagtgaaagacaaggcaaatgctgtcaaagagaatatcaaggatatgccgacacagaccgcttatgcggtgtattccgcaaaggaaaaggcaaagtccagcgtgtccgactttaagcgtggaatggttcaggaacagcagtccagacagacgggacgattggaaaagcaggaacagcatagacaaaatatcgctgacaagcgtatggagcttcaaaaggcacaagaagcaaggcaggcacagcgaaaggctgacggctcagcgacaacgggagctacccgtccccatgagcgaccagccacagcttcaaagccgagtgcggaaaaaacgcaggaagtcaaacgtcctgccacagcgactacttcaaaagcaagtgagccagtcaagacaaatgttatcaaagagcgtccgttatcttctggtgcttctgatagaaaagcgacccagcctacacaaacagtacataggcagaatgtagaaaaagtggtatcgcaggaaacacgccagaattacatcaaagaccgcaggacaaaggttcagcagacccagagcgtccagaagaaccagcaaaccacagagaaaacccgtaaccttgtaacgaagaaagggcagaagaaaaaatgaaactgaaacatatcgctctcattggtagcctgtttcctatcctcttttctctggtgcttttctttggggtattgattagtgcggacagcgacgacgagaacagcaatttttcttctggcattacgggtatgaacttatccgcagaagtcttgaaacatcagcctatggtggaaaaatacgccagagaatacggcatttccgagtatgtcaatgtgctacttgctatcattcaagtagaaagtggcggtatggcagaagatgttatgcagagttcggaaagtcttggtttaccgcctaattccttagatacggaaagctcaatcaagcaggggtgtaagtattttgcgtccctgctttcttcctgcaaaaatcaaggtatcgacgatttgaatgtagcgatacagtcctataattatggcggtggctatgtgggatatgtggcaggaaaaggaaaaaaacacacttttaatcttgcagagagcttcgcccgtgagaaatcgggtggaaagaaagtaacctacaccaacccgatagctgttgcgaagaatgggggctggcggtatggctatggaaatatgttctatgtggaattagtcaatcaatatctgaccgtggcacactttgataatgcgacggcacaagcgattatgaatgaagcgttgaaatatcaaggctggaagtatgtgtatggtggcagtaacccgaacacttcctttgattgtagcggacttgtgcaatggtgctatggaaaagctggtatctccttgccgagaacagcacaagcacagtatgacgctacccaacatcttccactctcgcaggcaaaggctggggacttggtgtttttccattctacctataacgctggttcgtatgtaacccacgtcggcatttatgtaggaaataaccagatgtaccatgcaggcgacccgataggatatgcagacctaagtagtagttactggcaacagcacttaatcggtgcaggacgagtaaaacaatagaaaggacttgaaaaatatgtttaagaagaataagaaacagacagaaactatcaaagaaccaaaagaaaaaaaggtgcgtactgtcaaggtaggcacacataagaaaaccgtgattgcgttgtgggtggtgcttatcgcaagcgtgagctttggagtgtataagaattttactgctatcgaccagcacaccacccatgaaaaagaaatcattgaacttcgcttgcaggacaccaacgggatagaaaatttcgtcattataaactcttggtctttcttttttcgggactattcttttttcacagcccctttgaaacgctctatgcctgccggtcaatcacctttcctgtccggtaataggtaaaatcagcagtaaccagaactctttgattttcatccataagtttcacggtatatacgccgatccgtcctccctgtctttgtacttccgcttcaccgtacacgtagccggtatctttcacagcctccagataattcattttcccgtcaatcgttgtaacataattgccataggtggatgccgccacaccggcaagtgtatcggcaagtgcatacgaacatccgccatgcattccaccgtaaatattcgtaaaatgctcatccatgcgcattcttccgtaagcatagccttcccgcacttccagcagttccattcccagaagctgtgcaaatggatttttctccaaaagccggttcagcttctgtggtgtcagttcctgtggctgctgtgactgttgtactgccttttgttctgttgttttcgttgcagaaatatgtttgtgtttcttactcatgttttcttcctttattaccgtttttgtcaaattttgcaagatagggtttatgaactttattgtcacgcgtcaaattatagttcctacatttaatgttgctccttttcttcatcacttatattactaatcttttcatccacaattcatattagggttatgcttagggttattcatataaaaacaatgagttttgttgatttctgatccaatcataaatattactttcatctttgcctaggtcttttaattcaacatacttcataaaatctgtcttatctccaactgtcagcatataaatataataaaagacattatccctatattttctcaaaagtgaatatgcatctgcaaaattagcgttcaggcagcaatatcgaatactttctgccgttctacttacagaatcaagaatctgatttccactgataactccgactttatgtaaaactatgttatctctgccatatgctaagaaactcatttcatacatgaaatttcttgtttcctctagcaatgtattcaactcttggaaggaactattttccttaatgacacttctatttatttcaaagtcatctggtatttcaagcatatgcactccttaatcactctcagcaaccccaaacttatttacaaaatcctcataaccatttacccaatcaaacttcgtatcatcggatactgctttaaaatgaagttctccgcaatgaatcttgttttttccacatcagtcaggtcagcccattattaccttcagcaaggacattatcagcaaataatccatttgctaactgcaccttacgcaaattttccaacaatctgctaccaacaacaatgtcattgtttctgacaggatcaccctcaccaaatttgcgtgttcgtgacggcctgtaaattccatcaacatgtcttgataaccctctgaacaattccactgtagaatgaatcgcctgtatctgataatccagatcatcctcaaattgaaatataatgcgcttaggcatttggctctcctcctgcttcttctgcatctttttgttgcaaataaaaaatagccttttgtgtctctatttcctcacgcaattcttcttctgtcggcaaatacaatttgtacttacttgcaaatagctgttcatttccatgtaatatagaataccttgcaatatcttcatccgtttccgaacataatacaattccaagtgttggattatcatctggcgctttttttaattcatcatacatacgaatatacatgtccatttgcccaacatcctgatgcgtaatcctctctgtcttcaaatcaattaatacaaaacatttcaaaatataattataaaacaccaaatcaatataataatcttgtttctcagtgtggatgtgttgctgtctcgcaacaaacgcatatccttttcccatttccatcagaaatttctgcagatttgttataatacttgactcaagttttgtctcgttaaaagatgcatctggcgttaatcccaaaaactccactactacaggattttttataaattcaagcttatcattttgatatgaggatgtcttttctctcatttcagcttctacagcttttttatcctgtgattgaagcatacgataataatattggctatcaatatttctctgtaaagtacgaacactccatgtctgctcataggcttctttctcataccatttgcgagctgtttcatcatgcacttgaagaagagtacgataatgtgaccatgtgagtctaatatcagattgtcgacacgctgtgtcgacaatctgtggaaaagccttgtagaatcttaaacagtgatataaattactcctgtcatatccctttccatatttttgagtcaggtaccttgataaatttttaataatttctacaccatattcagcccgttcttctccagctaattcttccactgctattcgatatccaatcaaccaatttctttgtgataatattgtatttactgaacgataagcttctttttgtgatacttctataatagtttgaacatcatttagtatgttgtctgttttatgaaaattatccataataacattatttacactattcataacttcattcatctgcctgcctccttacggcagattatacatctctgccatattttctatataaattccactgtatatgtaggtttgctagctcctgcattcttttcaataagagctttcagttttctgaatgtctcatcctttaaagaaatatcatctttaaatgccgaatctctgaaaataaatttaattggcaatgggtcaagctttgcaagttttgaaactaaatcctctgtgattgttatttccaagcataccaaataactgcttgcatagagatatgtacgactcccaatatcggataactgctctaatgtttctgaaagtgctacatcacgctgacgaagcatcaattcatatacgatatctatgtcgttggcacctggcatgaagtcaacaaggtctggtgcatactcaagctgattaacattgatctgtcccatatccatgatggaattccactttatattggtatcggcagttctaaatactttaaatccaatatcgatgtctgcatctggatggtctgatctgattttatctcctgctctacggatacgttctttacctatttcacatatatttttataaccggctttgctcgctgtaccgttatcatccgttaattccagtatttgtgttactataaatttacaattactttaataatattaactattgcatccttcttgttctggagaacttcattaattttctgtatcatctgctcattggaatttatcgcattcatatatcagccaactccttgctgaacactttctctagctgtgttcttattgattatctcaaaataggtgtccaataatctgtaccttcatctatgttctctcaaattttgtacttaatattagttataaaaacttaaggttaattatatcacaaaacgctaaccatttcatcaatattatggagttgtctgttctttgaaaattgcaaagtttaattctaccatccatttatacagtggaattctcttctgatatccggtgaggagttattttaatttggtaacaaaaaatgccgtatttatgcggtctgtggcgtttcgcaaacgcctaattgtaaaaatgaaagaaaggaggttccatctatgagcaatgacatcacagattttgtacaatctacgattaccggtggcatccgaggagccttgggtgaacttgcagtccgcggtattgatgaggcacgtctgatccagatgtttattgaggctggcgagacggttgccggatacgaatattacaaaacagaggagaatgatcttcgtgcacgcttttttgacagggaaagtatgacaacgctcgcgaagatgatgcgtagcatcgatgatttctcatggatagatgccttggagaaggaactggatcacaagttggaaggtcttgaggcgagcaatcgcgagaattgcaaacggcattttatggagattattacgacttctcttatgcgcaaccgaccggatcagtatgaacattttttgcagatggacacgcatacagaagtgcttggaatgcgaggccaggttcagaatatctcatttgaaatgcagagagtgtttgacgagatgaggcagtggagacaaaaccaggaagatcatctgcatacgagacaggatcggagcgagaaccgtgaggcgtatattgatcgggatgcggatcagatggaatccaggttttacatacccagttgaaatctgacatttcaggatgtgcggtggaaaccgggaactgaatccaaggagcgcgaggtggatatccggacgctgacagaggcatggagcaaggagctggcgacgtatccgcattggtatgttcctctgtatgaagtgtgcgaggaattggcgagtaagacttcggaggttggcctgttgcaatgccatgcggaggttgacagcgatatgatgttcgatttctgttacgaactggtgtggcgatatgagaaaagcatgaatgattattcggattatgaagtgcgcaatattcgtcagatctgggagaattatgcccaaaactttaagaatcccggcaaagaagaacttgcggttgcaaggcaggaacaagtggagaaatggtttgacgttggtatggcgctgcttcgtgaatatcgggaatgtagcatggatgcggaatgggatgcagtctataaagctttaaaaccgtatgcgaaatatcgatggcatggagaacagatcttgcaggtggagaaggcaaaacaggcattttttcagatggatattccggcgatgcgtagatgtcttgatcgttgcgatttggataagacagattatgagctgcggttgcagatgttaggaattcgcgtggaattagatgaagcggaagctgtcgttgaagaattgcagcgactgatccaggagattcgtcaggcgagtgtggagcaaccggaaaattatttgtattatacttcgttacacgcttgtgccttacagttatatggattatgtgtgcaaggggtatgggatcactgggggatgaggcacatcaggagactatcaatcgtattgaagatgaaatcgagcgttatgaagaagtgtttgattggggaggttggagaaataggactatagatcaactccttcgttgcatttggataagcatgaggagaaagaggcatttgcattaaatcgtgagatatattcatggggatttggcagccattccatgtatggactatggagcgtttactaaatacaagaaagagaacttttagaagcgatactaaaaaatacttcttgaaaatattacacataggtaatataattcttttaggaggggataaaatgtggagttagagcgaattgttgcatcaggcttaaccaatatatattcattgtctactgtgcaaaaagaattcagaaattcagtgaatgaaacttggaaggacgaagaaccctatccgagatatcaaaagaaattattacaagatctggctgttcttgaagatctaaaagaagaagcaatcacattacctcaatttgaaaagcttactggtgaagatcgactgtatagtataagacatccacgatctcagaaaaatattcgattattatatactatagaagaaggcacgattattattttactatgtgcttttttagaaaaaagcacaaatgactacaaaaaagcaattgcagttgccaaaaaacgacttaaatggctagatgatgattagtataatatatgtagtcagaacacaaggagaaaaccatatgagtattactgagaaaattgctaatgcaaaagaaacaacctgggtcacagaagcattatccgaggctgaggttaaatctaccgttgaactggcaaaaatttctgctagaattgaaaaatgccgtcaaaatatgaatatgacgcaaaaagaatttgctgaatacatgaacgtatcacaagggatggtttctaaatgggaaagtcgtgaatacaattttaccataagatcactaaatgaaatttgtgaaaaattacatctgtccctaaatcttgatatgcaaccggtcaatatggtaaaagaatatccgattttaaaatgggacgagattaagcaacgaacaaaatctcagaaaaatgattggataaaaaaatataatatgaaaggagcaattgcataatggaactaaacatgatttctgcaggaattgaactccttggtataacagttaaggaattagaagtacataatcaaattgttgatgctgaaatggatgccaaacgtgtttttggcttgaatatatgtgaaccagagtttcaactggatgacgacacaaaagaaatatatgctgaaatgacaattgaatttgatattgaaatcatccaagctgatgatagttcttgcaacattcatttatctgtagaaggagcctttttatctgccccagatacaaaaatggacgattttcagccactcgtagctatcaatggtgcctctgctctaattggtattgctcgcggaaaaatagaagctatatctgcctctatttttaataatggaaaaatcgttattccatttgtaaacgttattgattattataaggaaagtttgcatgaataattttgtggagtcagtaatcctgtgattactgactcctattatatttcttaaaagttctcttttctaatttttcttggacagttaacaccctattgctcaaaagcacacttcctcattttttgtcacttccgtgttacttatccggtctatttttctatctgccatttcaaaaaagtctccattttattgcatttccaacggttattctcacacggatattttgttaaggtaactcctaagaagggtaaagctactaatttaaaggctacaatcacagttaagaacccggcattatcattaaaggcagctaacgaagttgcagttggcgcaacagagcagattacagctactgttaagcctgctgacacaaaggttactttcacttcaagcgacgaaacaatcgcaaaggttgatgagaagggtgttgttacaggcgttaaggctggtgacgtaacaatcacagctaaggctggtaagacaacaaagtggtgctagaatataaatagtacaagccaaaatgagaaattccaaatacacataatgatagttgctgcactactgaatttgtgtggaaaaattcagacaaaatgcagagcatatgaaaattaagaaaatatggaatgaacaactgatataaaaggaaaggtgaagttaatttatgaagaaaaaaattttatcaggaattttagcattggcagtaatgatttcatgttcaaatggaataagtgtcagtgcggaaacattgcagtcaacaccagaaaatattatatctgaaaatgatggacagatggaatttctgcaaatatcagatgaagaggttcctgcaactgaaattcccgaaacagagctgaatgttgaggaaagaaactatacgggaacggaattatcattatctagtattatgccttatagtgaaaatgatgatgtatctaatgcagatcctaattatgcatatcttgttgagaataataatgcatatcagggaagtatagaaaatgaaaaagaatttcggtggtatagatttgaaattacagaaaaaagcaaggtgacggtctttttacagatggctgaaacactggacgctgatttatatatgttttccctagatacagaaacatattctttgaatttagttggaggaagtgctactgaaggcttaggagtatctgaacactatgcagatgtcttggaaccgggcatatattattttgcagcaggcggatatgagggtacaggaaattttgcgtttgcattttttaatagtgcaaaggatgctggttatgaagtgaatgatacattatcaaccgcaacaaacatctcaataggctcaagtgctgttggtgtattagatagcccgcttgatatagactattataaagtatctgttacaaaaggatatattatgaaatactctatatcaacaacagacgactattcacttgtgtatgcaggaaagtcaggaagtaatgccgcaatatatcaggttggaaatgaagatgataaagtattaattatgccgggggtatattattttgcggtattaagcaagaataatatgtattctgcgacgtctgaatatacagttaatttcacaaaagtacatgaactatcgtctgatagttcagcaaaagtgattggaatatgtcaagaagcgggaattgtatttcaaactaatagttctggttctgtatattatgtaaatggaaaccctattgatataagctattcatattcaaatagcagttctaattctggcggttcacagtcatataacatatctataaaggatagggatgatgtttatgcgtatttgggtgatgatgcacttgcaccagcagccatatattatatgaagtcgacaagaccagctatgaatgtagggagtagagcagctttagaattgacattttactctgacagtaacttttacagcgttcattgcagatgcacaggcgcatataaagagaataatttgtggcaggattttaaggctgtaacagttattattgatccatcaacaggtaagttaatagatatagaaagttttaattattattatgattatgcagtgggatcaaattccttgacatttaccagacgttatccttctatgacattatataaatatggaaattgaggtgtaaatatgaaaatatctagttatatgaataatatgaatcccataatagaaaaaaatgatgctaaagttcagaaagaaaataagcaggcaaatgaaaaacatacgatggaacaatccgtaaagctttctatttctaatgatggaatggagcattatcgcaaacatatacagcagaacgggcaggaaacctatgatgatgtacttcagaggagagaactgttaaaaagtggaaaaatcagtgatgtagattatggttatgagatttcaaagaaagcagcagaattgaataaagatgctgctaatgctgggcaaaatgctttaagcactacagacagagcaaatggttatgttgcagcatatgcagagttgtatgatgaaattgttcaaggatatgaatccggcacaagggaaatatatgtcacagatgaaaatggaactcataagcttacaaaggatgaagagttaagcaatttagatgttgcatataaaaaaacagtggatgactttgtgacaatggagacaacaaatcagcatgcccgtggaattattggtgaagaaatgaataaaatttcaaaaattaccgcaagatcaactttggcatcgacttacattgaggagcaaaaaaacagaggaaaggacgaaatcccagaaaatttaactgagaagatgtatggtgcaattacctcatttaaggagaaatatacaatgattcagcctaatagagagcagttgtcgcagttattgatgagtattaagatttgatgatgttagtactatgatttacaaataaaaatagtaattatatatcatattgaggctgagagaaatctaacaggtgacatagtcggaagaactccggataatgaagaaaggtggaaaataaaatgaaaaaaagtttaaaaagatttatcggaatgttggcagtcgttgcactatgtttaggtatactaaatataaatgcaattgatgcacaagcagcaacatctataacaggtaacaatacaagatcaacagcttacaattatggtagatggtcatcaataaattcaaattacgcaactattattttagagaatggacaaacagagtcttggttgcaatttacattaagtccgggcgaacacatttatttaagagcatcgtaccaagaggaatatgcaggtgaatggtttgaagtacaaaatggagtaggaataacactgggtacacctcagatgacacctcaaaatgtttataacgcagacagtattacaccagatatatatttggactgtgacaatgattcaacatctacaagaaattattatttagttttacatagaggtagcgtagacataaacaaaagtatctacttttcattatcagcttatgaaagaataaagacatcatcagtaaacgtttcaatttctggtacagcatctaataagggaaatagcagtattagtatgtcaggtgtaaattcatctgttatatcggtaaatttaactaatgatacgaaaattcctaacaaagctatagttacgaggatttcatcttctggaacacagtctcctagtcaggggaatgtgcatcatatgattatgcctgcaagtaatggtaattggtatacttcaacggtttccagtgcaagtagtgggcactataacattgatattgatgatggtatacctgttaagcagaaatggagcttcaaatataatgctcttgctacagctaaatcgacaatgagaaatgttaaactaacgatagagtttcagtatgatttgcatgatacggattatgagacttatataaggtaggggatagtatggttactgtaaataattattacaacaacataccagtaggcagggatttaaatttaatcaagccctcgacctattagtaacagtcagctccatgtgttgccacacttccacctctgccctatctaccttgtagtcttcaaggggtcttactcccgaaggagggatatctcatcttgaggggggcttcacgcttagatgccttcagcgtttatcccttccagacttggctactctgccatgccgttggtcgacaacagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactcttcaaatggtttccgaccattctgagggaacctttgagcgcctccgataccctttcggaggcgaccgccccagtcaaactccccgcctgacattgtcccactgccgggtcacggcagatggttagaaacccagtactacaggggtggtatcccaacagcgactccctacagactggcgtccatagttctaagtctcccacctatcctgtacgtgcagtaccgaatcccagtatcaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcccaccattcagtgggcaccccttctcccgaagttacggggtcattttgccgaattccttaacaatgcttcttccgtcggccttaggattctctcctcatccacctgtgtcggtttacggtacgggcacatataaaacaatagcggcttttctcggcacatggctcacatacttcactactaaatttcgctccacatcacgtcttcggcttatatgacggatttgcctgtcacacacctaccccgcttgtaccggtctttccattcccggcttatgctttccacatgcgtccccacagttctgtttatatgcggtacaggaatctaaacctgttgtccatcggatacgtcttgcgacctctccttaggccccgacttacccagagcagatcagctttactctggaaaccttagatattcggccggaaggattcccaccttcctctcgctactcattccggcattctctcttcttatccctccactgctccttaccggtacagcttcgtcggttttaagaatgctcctctaccactccttacggagtccacggcttcggtgttgtgtttcagccccggacattttcggcgcagggactctcgactagtgagctgttacgcactctttgaatgtatggctgcttctgagccaacatcctagttgtcttcgaattcccacatccttttccacttaacacacactttgggaccttagccggtggtctgggctctttcccttttgaccgcccaacttatctcgtgcagtctgactcccgttcatcatctacatggcattcggagtttgatattctttggtaagctttgacgcccccgcggaaattcagtgctctacctccataagactaaaacgaggctagccctaaagctatttcgaggagaaccagctatctccgggttcgattggaatttctcccctatccacacctcatgcccacccttttcaacggatgtggcttcggacctccaatgccttttacggcatcttcatcctggacatggatagatcacccggtttcgggtctactcgtactgactcatcgcccagttaagactcgctgtcgcttcggctccgtgccttaagcacttaaccttgccagtacgcgtaactcgccggaccgttctacaaaaagtacgcggttgatcatataaagaccttccacagattgtaaacacagggtttcaggttctctttcactcccctcccggggtccttttcacctttccttcacagtactatgcgctatcggtcactaagtagtatttaggcttacggggtggtccccgcgtgttccatcaaggtttcacgtgtctcgatgtactctggataccgccttgtcagttttcctttcgcttacggggctttcaccctctccggcaggctttcccaaaacctttctgctagaatcactgaatcaattatgcggtccgaaccccgctgtgcacgcacaacggtttggcctctttccatttcgctcgccgctactctggaaatcgatgtttctttctcttcctccggctacttagatgtttcagttcaccgggttcccttccatacgttatggattggcgtatggatgactggagtccttccagccgggtttccccattcagatatctgcggatcaaagattatttgcatctccccgcagcttttcgcagcttatcacgtctttcttcggctcttagtgccaaggcatccaccctgcgctcttttttgcttgattattcaatcctcgttatcatagcgttgataactttcgtaaccaacttctggtcagttacttattattcattaaagaactttacggttattacgatgtcttgatcaaatagatatttaatcatcttatcattctgtatgaagttttcaaagtacatcgcccctgtataaacaatcttatccgccaaagcatccagctttgtcttattctcaaaataatccgtatccaaacgcacttcaattgtaagcgcatagttttagggcgtaccctataaatgaaatctgacaccccgcgctaggatgccagacatgcgagtatttcactacattttatttacaagtttcctgagccaatttactccacggggcaaattgttccaattcctcgtctgacatttctgcaccagggcgatgctccagaaggaagctcagatatttaagtggatcaagttcattggcttttgccgtttctatcatagaatagattttcatactggcatctgccccggctggtgtatcacagaaaagccagttcttacggccaactaccaatggccgaatgctgttctcactgagattattactcaggctgcatgcaccatctttcagatagttcatcatagatgcatagataattccaccctatgctggtattatcgcacagtctgattatttcagcgagtcggtggattattcagcgcttacgtttatggcactctttctttaataaacgtcgttattatcttttcatatccctctggatcttttttataattctctgcatgtcctgcaccatgaactatataaatttctttactgcttttacaactattataaatttcttttgccatatataatggtgccaagttatccatatcaccatgaataattaaaatcggaatttttgtctgtgataccgacttacaagcatcagcctcttttaaattaaatcctccccaaagctttattcccacatctgcaaaaattttgaatacctctactggcattcctttaggcaaatggctcttacaatttaactctaacatttttgttgatgttgtaaatccactatcttcaataattccacaaacagaatctggaaaatccaaattactactcattgtgaccactgctccacccattgaaattcccataagaaatatcggtgtttctcttccaaaatgttttgcagcccaattagcccaatttacacaatcataacgttccttcactcccaatgtgaaaatatttccttcactttcatcatgcgcacgcatactaacaagtaaaacattccatttttctttctgcgcaattttataaatcggcacaccatccacgtaactatgacctctaaacccatgaaagaagattactaatggagcattcttctttctctcataataatgaccttccaactttgttccatcagaagccaagataacaattttttcattattttttcgctttattttatatgcttcggtaagccactcatattgctcatcatctgctgttcccaaatctggccatgctgtttctcttcgttcactaattttttggaacactaatttacttccttccccaaaaattattatcgaaaaaataaacattataataactactgcaacaatctttttcattttcactgatctctcagttattgcaagttgttttactctttgcttcataaacatcactttccttcaacaaaattaatccagtaacacttgattcgttgtaacaatagcaatatacggatctaattcaaaaacttcatttcttgtatcgcaaacccaaactccaattggtatattttctgatttgcatctttgtaccaacgcattatttaaacacgatgtcgatattgacaaaaatggtgtattttctgatgtttttaaactctgaaccatattatatgtattatcattcacatcaactgtatttaatccaagttctgctttcggatctgcattcttcatatactgcaaatactcaatactaaatgacacccatgatgttttctcccgcatattatatttatctacaatattcagaagttcataaactctgttctgcgtaatattggatttcaattctacgtatggatgaatatcatgtgtagaacaaaatgccataaattcatcaaacgatggtattttttcacccgcatactcttcacttttccatgaaccaaaatcaagtgtccgcacatattcatatgttaatgacccaattttcccacttccatttgaagtacggtcaatagaatcatcatgcaacagaaccgggacatcatctgccgtgaatgtcacatctgtttccacatatttatacccatactcatatgatttctgaaatgcactcatagtattttccggtgcagtttcattatatcctctatgacttactaaacgtttattatttaataatccctgcagggtctgtgaattatatacttttatctcaaaatcatattttttcccactttccacatatgcagaaataatggaagtccccgttttatgtgctgttaccactccattaccatctactgtggcactttctatgttattactctcccatctaacagcttttccaccatttaacttacaggtaacggtctcccctacatccaaagtttctttttcagatgaaatatatggtctctttgctataatttttctcttaacactttttcctttataaaccgctttaatccatacttttcccgcattttttaattttaccctgccactttgattaaccgttgcaataaatttatcagaactataccattttatttttgatgattttcctttccattttaactgaatgttctttccttcataagatgatatgtttttagcataattaacattatatgtctttgcatcgacgtttgtagtattcaatgccactattacaagaatcataatagcacaacaatatttgattgcattcttcattatattttcacctctttgataatttttactgtatgttccaatccaaattttgcatcaaacaatccattccatcccaagccacataacttctcactattcaatcaagaattattcatcgggttaaatgcttttttttcatcctgtgatggcaattcaaacaggctggacaatggaacaatatgaacatcaatacagacaggcatttgcagaagcagcaaaagccgctgatcctacatggaaagctgggaaaccaataccggctggtgcattggatggcattaccagagagtctgttgagagtggcaagaaatcagtagatataaaaatatagtatgttttttatgtggcatatatttcatttttgaaggaggttgctaatatgagaatatcagaaaaagctaaaaagacggtttcaagaaaaacgtttatggcagttgttgtaagtatgatggtttgtttgctttttgtaacaccagtatttgcagcttcaagtttttatagtaagacaactactaagctgaatgctataaatggaggaaaatcaacaaccagcagtttgtcatctggtagtataattggatcagatgcttcaatcacacaggttaaattggcaatcaatgtttcgagtggaactgatccatataccctttggataaagagtccaaatggaagttggcattcttatacaggtccgacatctagtaaaatatggtatttagacgattttaatggagaaaatccgtcaggtacatggcagatatatattgtgaattcaggaacaacaactcatggaaacatatatcctgtatcaacggttacagtaggactgactgtgtattataattaagaatcaatggtgctgttaaataagaaatgaagtatatgccataaataaagtcctcttgaaaggaacagtaagttcggtacaggaggacttttttgtatgtttttataaagtattatattgtatggattcaaaaaagcggcaaataggattcatttcaatgacaagtgtttattattaagaaaaatgtcacttgatagataattatggaaataattacattggtttgttatactaaataaaaagcaaagggggaaagttatgtttaagaagatgccggtatgcagactgatgatttcgtgtccttctgatgtaaaaacagaggtagagattataaatagagttgtggataacataaatgattctataggtatttctatggatatttttgtaaaaacgctgtattggtcaaagaatgttatgccagaagcgggaaattatccacaaagcattatcaataaacagattttagataaatcggatgcaattattgctatatttggtaatagaataggaagtcctacacaacattatgaatcaggaacaatagaagaaattgaattgatgatacagaagggaaaacaggtatttgtatatttttctgataagccagtacgaaaaagtgaaattgatatggaagcggagacaaagatacaggcatttaaggagaaatacaaggacagaggaatatatgttgtttatgcttctgatgaggaatttaatgattatgtcagtatgcaccttacacgctatcttacaacggaacttgcaaatgaagtaaatcgtgtgaatgagcatacaagatttgacgattctatatcacagagaaaagaagttgatttaatttacgattatactaagttttatgatataaaacaggttagttcttatactgattcaaatattatgaaaataagaacacataaagacagttttgaaatggatattgacataatcaatgtaaataaaatagaaaatcaggaatttgcaatggcattatttgaatatgctccatgtgataactggtcagctttttttgaagcaggatatttttttgaatttgatgcggcaagtagtggcgatataagagcttttcaattggaaataaaagatgatatacgaaataaggtaattgatagaacattacaggttagctgcgaggaagaacatttccgaatatggattccttctacaacaagagattcaactgcgtggaaaaaaatatcgcaggtttgttttgttgtatttttcaatagtacatatattgatggagaaaaaggtctgttgacaatcagaaatcttaaaatggtgccccgataggataatactttgaaagtatacagaaaagtctgaaagatatcgaggaaaatcatgtaagaggtaatgatagacttatttaagtaggtaagcaattttcggatttaaagcagtaacagaaaattaaaattgtagataagtaaataaaataatagaaaaaattatatgcatctaatccatttgcggtttaggtgctattttttttacaatatgaatgcgatcgctcgtaatatcaatatgtttatcaataaaaatatatgaagcaacagaacagatgatattatattcatcaacatttttgctttttaataagtgaaaagtcttacttcgtgcaaaaaaatcgtacttggtgcaaaaaaggtaaaattttataagatgcttgtcgatagaaaaagaaaaaataaggaggttttcaagcatgaaaaaacttaatgatgtagcattgaaattacttgcaaaagcagcatatgcaaacgcagagaaagaggcaaattcagcgtgcctgtttattggctatcagcctaaaatgccacagaaagtaaaagaactgaaagaaagaaaatagtattttcctatggacaaattgctgaaaaatgttctatcttgcatgaggacaaaaggacttctggatgaaaatgaggaagatgtatatcgctttggcttagaatgcttattgttagaggtggtacattacttgtcatacatagtaattggttttgctatgcgaatgataatacccatgattgtaactgcaatggtgttaataccattgcgtagaaaatcgggcggctttcatgcgagaacaaggagtggatgctatttattttcatgttccatagttgttgcggtatgtttattggataaaatcatttttccactatggttatgtactgtaactacatttggggcaaatgcaattatatttgcatttgagttttatagtgataggtaagcctctgatatcatctcgggcttttcccccactccacaccgtgcatgcgattttcaccgcacacggcgttccatcgattagtatttttcattatctaaacaatcaacctttgaatagaataaaactgttgtagttgaaataagattaaataggttgcatggaagccaactcacgaaggtggttaacctttataagctgtttgttatcaagctgtagtaaatccatatatttgtaaatagtctccgcttttgaagcatggataagtttatgaacggaattctttatgagaataagattctcataggaatccgtaccgcctaaatgtcgaggtagcttatgatggcaatgtatttcaccaacagaagagaattcttcccctgtgacagcacatttaccccattgagcggaaaagagtgatattcgattgtctgcgtattccacactattagaataggctggttgacgcatgagagccaacatcatggggatgttgattctaagacagttgtgaataccttctcgtccttcgggagtatagtagttccaattcttctttcgaaaaagtgggttcttgtgctgcgtgtaaccgattggatacacgggttcattcgtaccagcgacatatcgcatcatttttgatttaccaaaacgggctttttcaaactccgtaagctctcgccctgtttttacaaggcggttgcctgtgcgagtactaagcctgttagtcagcaaggtcatgactgtgcggttaagggaagcacaatcatgattaacatgtgtggcgatacagtaataattctgcatgccagtaaccatactgttataaagtcggatttcaccctgctcaccataaattttgcgagggtgaacgattctctttgcctgttctttaagcttctcccttttgtgctcgagatttttatctgcgatatgagatataaccacgagtttgttgccttttctgtgaactttcattttgaatccgagaaaatcagagtaatgatttcttacattgacaatcctcgttttcttttcagaaatttccagtttgagcctttctttcagccacagagtgactgcacatttggtgcgttcagcggagtcctttgtcctacaaaagattcgaaaatcatctgcatagcgaacaatgaacatttccttcaggttagatttcttagcctgtcgaaagccgttttcaggtctagtattccgtttgcaaatcggacaccattgccattgactttctacccagtggtctaattcgttaagcacgatattagctaggagtggcgatataatacctccctgtggggttcctttgtcgggtgtgataaaagtcccatcttccagtttgattggtgctttgagaattcgtcttatgacaaatatcagttgcttgtcatgaatacccatagcccatatctgtcgtatcagcttggcatgattcacgttatcaaagaacccttttatatcgaattcaatgacatagtgaagattggcatgttgaagtagctgatagcttcttgctatagcgttctcaaccgagtggttcggtctgaatccatagctgtttttgctgaacttagcctcacaaacaggttccaatacctgtttgatacattgttgaacaagtctatcccatatacacggaatccctaagggtctcgttttacttgggtcgtatggttttggtatctccttacgccttacaggttttgggcgatacccatgttcacttccattaataataaatctaactttttcaacaacctcatcgggggaacatcttccaatgtcctcgattgtgagattgtctgtgccacttgttttacttcctgtatttttcttgatatttctgtacgctagaagaatgttttcccgttgaagaatgacagacattaaatctgtaaaaacttctccgttcaaacttgcctggtatagattatcaatcgtattctgcattccgtaatactcattgtgacgcagattatcctcacagagcagttgctttttctttttcatggtcataaggcatcactctcctttcttgggaaagtgtccctttttgtcatactcgtaatccttataagattgaatgacaacaattgtttctaaccgactaaagcccattcctcgagcccgcctttttcgtagggctgtcgtaggttcgagcttcgcttttcagcacagattaagcggcttatatgattcgtccgcagattgcttatgagcaactctgtacctttccacgttccgataattctatctgtgcatatatccttaggtgtccgctatagtcctgtcagcttgattgtgcctgtaacacaatacggagtttcatattttcgattcttactccaccgcactgacccacaattaagtgtccatacatttctatatggtaaacatctagacctgtacattcgcggttttcgtcagtccgtcgtggacattctcaccatagatattttatagactcccgacgtgtcatctgcatacagtacctctaccgcactttcgacagctgtatttctacactgtttcggcagacttccgccgactttatcgagctcctgaccccaaccattacagtcggagccggtcgaagtatcagagaaggcatttcaaggcgttaccccatcattctacctttcgaattatcagttgttacttacctcgtaagaaggtaagtccgacgattttagcatcgcatggccataagtccatgaagttttaccctcatagagcgatgtttgtgcgtcaacgtgtcgcaccaaagataagcagttcatggctaattagttggaacaaaaaacgaaaggaaaagcacaatccagacggtatcagcggcaggctacaagaataaattgtgatttcacaagattggtgctataataagagaaaagttcctgccggggcagccgccccggtggtatagatagaaaggcaggaaaacaatatgcacatcagctataagccactctggcacacactgttagagcgtgatatgagaaaagaggatttaaggcttgccgctggtatgacaacaaatatgattgccaacatgagcaaagagggaaagcacatcagcatggatacattagcccgtatctgcgaaacgctgaattgtgagattaccgatgtgattgagttagtaccagacgagcctgcttccacaggaggtaaggaacatgagcgaattgaaaccaagaataacggaaaacggaattgattatatccttgtcggagattattacatcccggacttgaaactgccggaggaacaccgccctatcggaaagtacggacggatgcaccgggaatatttaagggaagtccacccagccagattgaatacattgatactgaccggggaattgtggacatatcttgcagacctgaacgaacaggcacaggaacggttagacaccatcatggagcagatgaaaactgccgagggcgtaaccgaggaattgaagcgtacccaccaaatggaatgggtgcagcgttgcaataacattcataaccgggcagaagaaattgttttgcatgagatgatttattcataacgggagcaattaaatcggaggtatataagatgattgaaattgtatttggtgaaagtgcctgtggaagtttgaaaattgcccaaacttacggcaagggaaagtatagaggaagtgctgtttcaatatttatgaggcatgaagacgggagtgttccatcttcagatgaaatgaaaaaagcacagcttcaagcacaggaacaagaacgcattgcttgggagaatgctattccattgggaggcaagagctgtgatgtttattgttttgatatggctcttagtgtgggagatatttctgataatggaattggcgaacagcggaaaaatgttttcaagaaaatgctgtctgtctgctttgtagaggatttagattatcaggttgaagaaaaaatacagaaaattaaaactacattgacctcagtgattgaacgatatgtagctggggaagaaattcgcatttggtatagctataatccagatgagctttgtggtatgtattggcttatgaaacaacttcaacccttaaactgccagacaacaatttatttggttaagttacctacatgggaatatggaaaagaaaatactatgacatccaaaatagcatggggcgaggtctctcctggcgaatggggaaactatataactctacaagagaaagctaatcctgtatttctttcagcttgtgctatgaaatggaatcaacttcaaaatgaaaatgcacctttgcgtgcaatgttaaatggtaaattgcaaagcgtttcagaagatatatatgatagtttcattcttcgtgaaattgcggaacagccagagcaattcaaaatggctattgtcataggtaatgttttaggaaaatatcaacttggaattagtgatgtatggatttccaatcgcattgataaaatgcttgaagatggtgtgttggaaattatacaggacgcaccaaagggagaaacaaattatcgccgaatattaagaaaacgaatgaagtaataaccacagcacaaaccgctgctacatggaatccaacaaaccatgcaacagcggttttcctttaccgttttttcctctggttgataggcgttcccgttttctttgatttttggagaatccgaataagccagcgaaattcttcatctgacagatttttatagttgataccgagctgcttgcagtaaagcactgccagtttttccaaacggctgcccttgaaattttcgaccgcttccagattttctttcagttcattggcaacagtggtctggggcgcactctcactatcctttttatgggtttcccgaatatcccggataatcaggtttaggtcatccagaaccatgtggctgaaatattcatcatcactgatatgggcggcttgcagcactttcaaatgtgggtcatcttcgccagggcgataccgttctatgatttcatgtcggacagtatcgacaagggtgttgaggttttgaatctgcatggtggcaatcccatccacataaatctcaatgtccgcaagaaacttgataaagtccttatgggtggcaagttcgcagagcagacggttgttgatccgaccgcttttcagaagtgcaaccatttcatcgttcaaatgcagctccgtcagtggcgtgttgatctgctccctgttctctgtccggcacagcagataatcgacggaaaccccatagaagtctgccagcgtgataaggttgccatgattgatttccttaaaatcttctttttcataactgccaagggctgatttagaaatacccgttagttttgatagttcttccagatttaagcctttgtccttgcggagttcccaaaggcgttcctgtatgcttgttgctcctttcatgggcacacgctcctttccaacggtttcattgctgccgcttatctggattatatcacactttccgtaatcgtggaaatttctgatttttacccttaattcctactttgtggacatacggcacagggcacaaaaatgttgagagcggtacggagccggtgatccgtgtgatggttgaggcacagagtgatgagctttgtgcgaagtatgtggatgagatggtgcaggtgatccgggaggaagggcttgcggtggagtagaatggaatagtgagatggtaaggggagccggcgctggtgcgccggcttgtttgttatatgtttttcttattatgttatgtttttgtggaattgaaacgcgaattgtcatttatataaaaaacacttgataaaggatatgagataaacggtagaacataagtacctttcatacttgaatctattatggcataattacactcatcaaagatagtcagtcaaaaaagttaagtactcaacttttttgaccggctatactcaggaggtaggttatgactacacaaaccagtcttatggcggaacaggtcaggctccaacagtgggcagaacaggtgcgggattgtaagaatcgtccgagaggaatggacgttgaaacatggtgtgctcaaaacaatattacaaaagccaattattattatcggctccggcgtgttcgaaaagcatgtttagatcaaatgcagacagaacaatcaaattttattgaactgccactaccctcagaagaaaatgtatctgtaggtactgaaaatgttccggatcctgttccagccatccgtattaaaacgaaagaaggcatttcttttgaagtacattttttatattgtaaccttaaacatttttattttcttctatgctaattctcaacacacattttttatattattcacctcacaactaggtaaacgcaccatagtgggtgtggctttttgattagccgctccgaagagcggcggcgttggttaccaaattattttctgcattctgctggcagcttatctgaccaagggagcagatcttcacagaaactagtatcatggtcatccatgtgctttggtatctctgttaaaagatattcgaaataatggtaaggctttaggttgtttgcctttgctgtttcagcaatgctatagatgatggcactggcttctgcgcccgcaatggtatcaatcataacccagtttttctttccaacacaaaaaggtcggattgcctgttccgcggaattattatccatcggcacttctccatcttcaaggaaggtttttaaatacttttcctgattcagagagtaggtaagcccttttgcagtcttgctcttaggcgttacagataatagattctgttttgcccacgtaaaataagcatcaaccagcggtttcacggttagctgacgatgttttagacgttcttctatagtcattgatgcaagtttgttttcttcgcgatagattgcctggatcgtaaacgcaccatagtgggtgtggcttttttcggaatttttggtgaattaagtcttgccagaacaaatgttcctgtgtattataaatgtaatagaaaaatagatgattatctatttgagaattttatggaaaggatgagaaaaatgaaaaagaagaatgggataaacaaagttatatgtagtgcaatagtattgttggtaattgacatctgtctatttattataaaaatttgttttaagacggaaaatgtaccaaacaaattttctgggattgaattattatttgatattatgttgcttttgtttggggcgattggttttttgttattattcagtgtttggggagttgcattgatcactgcatttaaaaaggggttgcacaatatacgttattctgacgataaattatgggaagaaatagatgtttataagcatcgttggattgaaaatggtgaatattataaaaaaatgataagagttattaattgcttttatcaaaagaatggaaaagtcgataaattggtaaaagagaagtcggtcgatagattatttttacgattggattttttgaacgcacaaatggagtttgaggatgatttgaaatcggcaattcaatcgctggttatttcggtagtttcttctgtaatatacggattaataacaaagaatgaatttagccaagcattaattgtaattatagagattatatcagtaatcgcattctttctgattgttattgttttttattcatggagaggaaaatttggctcatatgattatttgattaacgaatatgaaaagaaactattgttgaaaaagatagcaaagctgaataaagtattgcgtgttgcattgaagaacgaagaaacacttaaggcgcaacagatagtaattgatgctttaatagaaaaatgtaaaaaagccaaaaaagaagaccaagatggaattgaaaaggatatacatatagtcgagagtttgcagttggatgtcaaacacaaaaataaattgtatgtacgaaaagtgcaagtgggtaaggataaaatcaaattatattacagaaaggaaagagaaaactcatgttataattttgatctgctgattaatgatgagtacaagaaaatgtataagattcttgaaaaatatgaatggttataaagtacgcaatgtaaatgtgtaatgttattgtaaaaattaggtaattgcgaaactcgcgatgctcgttcgcaaacttgaatcaaaatagaaatagaattgagcatagcatgattttaatgacgaaaacggatattgagctgttttaggtcgcccctgtataaacaatcttatccgccaaagcatccagctttgtcttattctcgaaataatccgtatccaaacgcacttcaattccatccagcatattggcaaccatcttcgtatagccacctaccggaatcccctgatataaggcattaaaatagttattatcaaaagtcagacgaaccggaagccgcttaataataaatgccggaagatccttgcaatcgcgtccccactgcttctccgtataacccttgatcagcttctcgtaaatatccttgccaaccaaagagatcgcctgttcctccagattgtgcggctccgtaatgccggcttcgttgcgctgctcctcaattttcgctgcagcctcctccggcgtcacaacgccccacatcttattgaacgtatacatgttaaaaggcagcgaatacaactctcccttataattcgctaccggactgttcgtaaaacgattgaactccgcaaaacgcgtaacataattccacacttctttattatttgtatggaaaatgtgcgcaccgtatttgtgcacatggatattctcaatatcctccgtataaacgttgcctgcaatgttcgggcgcttgtcgatcacaagcactttcttacctgcatccgttgcctgtctggcaaataccgaaccgaataaaccggctccaacaattaaatagtcgtacattttcttatcctttatttccttctattgctaacatataaacttagtgatgagctacgtaataaagagttgcttcaggctatcgagcatagcagccgttcatttgaggaaatcatggacttccttggcaccgatgactcccaggattaaacctggaagccatcgagagttaatttttcaggaagttcacaatcagtgccgtaagaattccatctccggttgtggcatgcttgctgaaaatcacatgcccggactgctctccgccaagcacatatccgtttgtcacactctttcaaatatttgccacaccgattttatcgcaagttgcaaatggcagttctcccatctctccgtcaatatatttctccagcgcagcttccacctgttataataccagccaaggtaacgtccgatcttgtatgcatgatctgcggagagtactttgttggcttcgccgcgaaagccgtctgttccgaaatattttaacatataaatcttcccttttccttttctaccaactcaactaatctagtaatactttatttgtcgtaacagtactaatatatggatctaattgaaaaacctcatctcttgtatcacaaatccaaactccaattggtatgttttgtaatttacatttctgtatcaattcactatttaaacacgatgtgtttattgataaaaacaaagtattttcagatgtttttaatttctgtattaaattatatgtattatcattgacatcaaatgtatttaatccaagttctgctttaggatctgcattcttcatatactgtaaataagtaatattaaaagatacccacgatgttttatccctcatattatatttatccacaatatccataagctcataaactctggcctgtgtaatattcgatttcaattctacatatggatgaatatcatgggtagaacaaaatgccataaattcatcaaatgatggtattttttcacccacacattcctcacttttccatgagccaaaatcaagtgtccgcacatattcatatgtcaatgaagcaatttttccacttccatttgaagtacggtcaatagaatcatcatgcaacagaaccggaacaccatctgcggtaaatgttacatctgtttccacatatttatagccatactcatatgatttctgaaatgcactcatcgtattttctggtgcaattgcattatatcctctatgactaactaaacgtttattatttaataatcccggcagaggctgcgaaatacatacttttatctcaagatcatatttccttccatttcccgtgtatgccgaaataatggaaattcccgctttatgtgctgttatcattccattaccatctactgtggcacattccatgttattactttcccatctaacagcttttccgccattcagcttacaggtaacagtttcccctacatccaaagtttctttttcagatgaaatgtatggtttctttactataatttttctcttaacactttttcctctataaaccgctttaatccatacttttcctgcattttttagttttaccttgccacttcgattaaccgcagcaacaaatccatcagaactataccattttacttttgatgattttcctttccattttaactgaatagactttccttcgtacgatgatatcgttttagtataattaacattataggtctttgcatcaacgtttgtagtattcaatgacactattacaagaatcataatagcacaacaatatttgattgcattttttatacaccatctctgatataattttttcattatatttttgcctctttgataatttttactgtatgttccaatccaagttttgcatcaaacagtccactccatcccaagccacataacttctcactattcaatgaagaattattcatcgggttaaacgcttttttttcatcctgtgatggcaattcgaattatgaactcaattccgttaccagtgaagaatatctttttgtccggttctttatatcctcctcactgacaccataataacaatataaatctctggctattttcttaaacctttttatgaccgacttatttccagagtaagatattccaaatatattccaggtataatctacctctatttccattaaatcctcaccaatttttatttcatataaatgaaaatccatgggaattacattatcaggcatttggtcaatcaatttatttctaatttccatttcattcaaaaaatttttaacagattcttcattatgaaaatctggttttggaatatccttcctttggcccaaaagttctggtttatgctgcataatcaaactagcttttagatttttctgtcgttctatccaatttgttgcggcaggattgatttccactaaatcataatgatcctttgcgtattgcaccacttccgcaagggtatgcgggttggccgctattctcttttctatcctttttcgtctggattgatagatagcatttcggattctaatctttagagattgcttttgagcttctccaaatataaaaacacttgtgggaccatcttcaccatttattatggaaacttgattgatacttttatttttcataagtgccctctactcacaaatcccgattatatcggtgattcacaatcttttagccaaaatcgcagttccataaccgtcacagcaattttatactttacttcgatttcaatcttttctggtggattgactaaaagcctgtcaatatcattttcctcaacaccagccatttttgctatcgttagcttggatatgccataataggaaacaagcacttccaaaaaaccgcttaattgcctatccttatcttcaatcgctccaaaatacagaaatcctactttactaagtattttaagacgcaatgcaggatcatctggcaaacattccacattgcccattactactcaatctactgtttcttcagttatttctaaatattttgaaagagtatttttattaaaacgatactcctcaattaaagaagtcaacatttctgaaatattttttgtttttatcatatttgtgccttaatctccacttgtatcatttacaatattgcttgtaacaagtgtccctatgtgaaaggcacactctacactttattgttgttatcttccattttccgagcaattataacttttccaatctacgtttatcaaatgctccaaaatttagatgccagctcccgatttatgatagatgagagaaaattaggattattattctggaacactttcagactttcaaaaaaagccgctttattctctgtctttatatctgaaaaagttgcatccagcttctgatcttttacatttttctccacatattcctccgactgcttttcgtaattatcaaccatcgaaggattctttttcactgccccttcataccaatttgtaaggtattttaatgcattaagctgtctgtcctcattgctgctttctttactaatcttctgatattccgtgtatgcactgccgtccatcgtcctcatcatatcaagcgcatttgtagtctttacaatattgctaccatgtccaagatatgtacctttccctactccatagtccatatttccgttattgtcagcttttcctgcgctcgcaagctttgcgatagactccattgcttccaaaaatgattttctgctatcttccgggataaaattctctgccgcatattccgcttttttcataccaagtgaaatatttgcctgccgttcttcctctgtcatagagccagtatttccaacaaggaaattctgacggatgatatcatacacaaatccctgttcctctttgctgcagttctccaccgcagatgcaaccgccttgtctgcaccatacattccggaatatgccggaagttctagtgagttatcaacctgcgtaatttctttttggaacgctgcatttctcgcctccattgattcccgctgctcctgtgttacattggcatccactatacctttcttgttttccacaagtgcagccattccatctcccgaaaattcaacaataaccgcatctccatactgcgaaccgatgtccttcatcgcctgcagggtttcttcccttgacatcttgtccataatcttattgccatgttcatctgtagtgttaaattcatactttacaagggtgtctttcttatatgtaccattcccatatgagggaatattcgttgttcctctgtaaaactgactgtaatcaatattcataatatacactctcctctactttattttttcttaggtatttatgaaataccaaaagtctcataaatacaatatttttaccacataaaacatactatatttttatagtttcatacttgtatatatatctttccgataccttattacgagcagtctcaactaactttcttgctgaatcactgattttcacatcatcctccgaaataatattctgaggaacagttgttttcttctcaaccttattttttatcatttctggattattaatatacctatttccttgaactttcatagcaacctccttaagttagtccacactttctatacttctttatctatcttgctcgatgtcaaagaacctgcatctattttcaggtaatctacatcactgtcattgctcaatgaaccaataaaacgatttatatctactgactttctgccactctactctctggtgatgccatccaatgcaccaatttgatattttccttttatcgaatcctcttatgccttaatatcaaaacttgatctatcaggtgcagaaatactcacagattctgctacaaggctctgtgtcatactttttacatcattaccagttacggataaggtataatcacccgtttcttttccttctgccgatttttctgcacgtttctttgcagctttttcttcctctgcttttttagcagctcttttttcttttaccttttcctctttttctctgttctcttttgcctttcgttcagcattctctttcgctattttcccatctggatcatttgtacaagatgctgtctctataatatttccgtttgcatcaatcatataactctgatttgtcacagtgcccaaacatccattaatcgtatcttttgtacaatccggaatggctgctaagttttcctccaaatactttgctttttccggatcattcatgcacttttgtaaaaatgcacttgaaacagataccgttgtcggaataccctgcattgaagtcagccctatattcatataatggtattttccttgcaagtattttgaataatcatttacattactataccctgtcttaatctgctctgtttttgtcacaccgggacgtgatgtttttaattcaactgtacttgttgtcacgttgccgtcttttgtatttgtactatccttttcactatctgtttttttaacagtattcttgtaatttgaagcataatacgatgtgtaactactgttattgatacctgtaattgccataatcctacctccctgttattgaaacttaaaataatttctattatattgaacgacttggatatttaatttctctcagcctcaatatgatatgtaattactatttttatttgtaaatcatagtactaacatcatcaaatcttaatgctcatcaataactgctctctattaggctgaatcattgtatatttctccttaaatgaggtaattgcaccatacattttctcagttaaattttctgggatttcgtcctttcccctggttttttgctcctcaatgtaagccgatgccaaagttgaccttgtggtaatttttgaaattttattcatttcttcaccaataattccacgggcatgctgattggttgtctccattgtcacaaagtcatccactgtttttttatatgcagcatctaaattgcttaactcttcatcctttgtaagcttacgaggtccattttcatcagctacatatatttctctggttccattttcatagcccttcacaatttcatcatataattctgcgtatgctttaacataattatttgccttgtcagtaatatttaaggcactttttcctgtatcaacattttgattctgctgtgctgccttcttttgaatttcataactataatcaatatcactgatttttttactcgctaacagttcctttctttgaaccacatcatcatatttttcctgtccactctgctgtatacgattacgataatactccaatccctcattagaaatcgaaagcttcactgattgccccactgtatgtttttcgtttgtctgactatttcctttctgtactttatcagtatttttttccattattgaattcgtattattcatgtaattagatattttcatatcctatttttcctccttaaaacccattatcttagtttcacctcgtggctcacaaataaatctatctataactttatatctactgacttcctgccactctcaacagactctcttgtaataccatccaatgcgccagccggtattggtttaccagctctccatgtagaatctgcggcttttgcagcttctgcaaatgcctgtctgtattgatgttcatattgttccattgtccagcctgcatcatcccaagactcgctattatctggttggctaaaccttggataaaccggaatcccaccggcttgaccacacacccttagctgggcgcacaactggaatttgtctctatcagagtccgtaatgaattacccacttgttattgcttaatgcattttctaacagctttttcagttcggatagttcagaattatctgcaatgacatcaataaatgcctttagcgaacaaggtggaacaagtgtaacaccacagtatgcaagccctttgcctttgacggaaagtgtatgccaatagaagtcaatggatgtaagcctttcgacaacgccttccaaataggcgtcatcaacagaaatacaggcatatttccacggctcatactcgtcatatcgcttgccctgctgaggagcatccatcataattccaaactcgtgttttgccatgtagatcacctccacaaatatcgattgagatttcacctgttttagggaatttataaagtgtaccctttgtcaaggacactatgacttttccttttcagatttctattttatatttgtttgttgtgtagaggcatcaaagtgatgcctctgattgattgtttttaccttttgctttagggattatcagtggataaattcctgttgtcagatattgataatattcaacaggtgacaaccttgctaagtcccattgataacgttctgtattataatattctgtccaatccctaactgcgtttaatatctcctcatagccgtggcactctgatagatctaattcatctttcatatgaccaaagaatgattcctgaggagcattgtcccaacagtttgctctacgtgacatagactgtctcagttcgttatcctttaacaattggataaatttaatgctggtatagtgggaaccctgatcgctatgtattaatgtttctgtgcttaaatcagttccatgtttttctattaactgttttactgtttctaatacaaaatcaatttctagtgattcgctgagaacccatgacagcagttccttggtacaggcatctataattgtcgacatatagcactggggtgcttttccatttataatatacgtgatatccgttaacagaatttttcttggtccgtgttcctcgaattcacggtttactatattgggtgcggtatatgcagttgccattgcttttgccattctccgatagggatttgccttgcggatagggcactgtaagttgtacttcttcatcaaccgccggatttttttgatattcatcactatcggcggttccatgtgtaacagcctcatatatatgctacgggcacctttatgatatcctcggtactggtatgctttcagaatcagaagaaaatcctgtctgtcctgttcctccctttccattcgctggtcttctgttgagagataatggtaatatcccgaacgggatactcctgcaatttcgcacatggcagctacattcaatagattatcgtttttttgcatggtatcataaataatctgatactttgcatgggctggtattttcattattccggagcctccggatttaaagatacaattttttttagaaactcaatctcctgatctttatatgccagttgcatttctaaatattttatccgattttcagccgaaagatatccgttgcagccctgtgcataggtgttaagatctcgaaaaccatttcccttttttacttcatttccaatcatggttttcagaccatttattctggaatcccccaggatatttggatctatcccaagagtcgaaataatctcacgtgaaagcctgccctttgacagttcctcccaaaacagttttttaaattctgccgagaaatgtacaatgctcggtgatacatccagcacatatttgctatttctcagtgtgagcatttcctgttctgtaaactttctgtttgccataatttcctccaattcattattattgtaatatcaatctgaatcggagtcaaaaagcgattttgtccaaaatgaaggggttcatcaaaaccatgtccgaagttaagggttccctgtaaactcattgtatagatttaagggttttcattaaaacttactgtctaatggtaagggttttaaaaactcaatctgtccaatctatagggtacattttattaataactgttatattttgttattaaattctctgcaaacccttgaaaacactgggtttaaatccctgcccgctggaatgttgttataatagtcagaattatttacagtaaccatattatccccctgccttatataagtcttataatctgtatctttaaattcctcccggcattttattctcttattttagatgccagtacggtataaaattctttttcctgctgcagatatgctgccctttcctctgtaactgctgccaacggattttctattctctccaatactttgtcgatagctgctaaacaactttctttcgtttcaccaaaaatattgtcatcaccacctgtcagaaaatcctgctctacagataactgcgttaatgtactggttacatccgtctgaaatggattaaaaccagtttcttccaatgtttcctgccacgccgcctttacactctccggcactgtctgaaggtaataatcactaatatatgcaatctgctttttggtcttttcatctgcaaactggtagattctgttattcgcttttaactgttcatatgccgcctgcgcatcactgttcgcttctgactcataccaaccatctttatttttgctatatttcataccattgaccgtaaaatctttggaagtgtctacacccagataagacataacatccgtaattccctctgtataccgggcatattcctcctttgaatgtgctacagtagtcattgtcccacctgcatttcgcagcatggatgccaatgcatctgccattctctgtgcttttacatatgattgtgtatcatacggattatctccaccagaaacctctactccatgcgccgtaaccgtaagcacatgacctccattaacacggattctttgcccttccgcaatattaacagaattattctgtctgctaagtgacgaactcttcgccaattttataggtgtttttaacacttgaaccaaatcttctaccggatttagtaagtgctgcgacatcgcctcattataggtttccttatctttaatagctgtatttttgtaattagatgtaagtcctcttgtattaggattaatataacttgatattgactgcattgtctcaatctccttcgtttattctaaattctcttttccttctatgtccaaataactaagccttatttatacttactatttgcatttggcaaattaagatatgtatccatacttttcgtccaaagcaacgataagtcaaaccttcccaatttgtttaaatcttctatgctttttttgaacattgagataaaatctcttctgtcgttaagtcccatattaccagcttcaagcggcaaagatgtgaaacctccctgcttctccactttgtaatgtgcctccaatgcacgcatttcgactactgtagcacttgatggattaacgtcattgatatatattctttgttcaaactcttttccattttcatccacacctttcgctaacaccaccggattttcatccgtcgaatcatccgcatatttaagacaataagaaagaccggtgccattacctcctgtccacaacatattatctgttgtaaatatctgatatacctttggtgtttcagccgtataaaatgtcttttccgcagatgcaggggctttcatttgattacctttttgttgaccgtacaatgaagatacggtattcagaccagaaccaatgtgcatacttctattcctccaatcagtttatctgaattgtaccgtctgctatgacaaactgtacatttaactcagacataatatctttgtgctgtatccggttatatgctaaaatttcccggatatcgtttgcgtaatcctgataggtcagattcctgcctggattattcaacagatcatccagtgttttcggcagaccatgtatcgttgcatcttccactgaaaggtctccaagcgatacgttgccaccggttgccttatgtaaaaatttttccacatccactgcagcttttaacagatacttttctttatcggacaacacctgtatttttgaatccatggaaaaataaatctctatcagctcatccgaatgttttgacagaacattctctatcttctgtttcattacattatcatggataccgtccacacttacctgaccatccgtcccaatttttatggaaaacgtggaatctgaaatatcaattcccacttcttgcaaacgttcttaaatgtggcacaaggagaaacgctctctaacaagctggttcgtgctggacgagctatgcaggcaggcgtttatttcgttacacaatcttctggggacgtggcaaaggaaagtctgaaaaacaatatcggcttaaaattcgctttccgttctactgacatcaacgagataaaacagaccttagaatttttcggtatcgacaaggacgatgaaaacaaccagaaacggcttcgtgatttggagaacggacaatgcttattgcaggacttatacgggcgtgtcggtgtggtacagatacacccagtttttgaagaactgctacacgcctttgataccagaccgcccgtacagagaaatgaggtggagtgatgaaagaaaggataaaaggtgcgttcacaaaaaggaggatacttcactttctcaaaacggctctgttcgtggtggcactctcccttatcctgctttcacttttggggacggtggctcatgcaacgggacttgtagacgatactatcaatgcagaaaatctttactcaaaatatccgctatctaactaccagcttgatttttatgtggataatagctggtcgtggttgccgtggaactggctggacggcattggaaaatcggtacagtacgggctttactgcattaccaactttgtctggacgataagcctttatttaagcaatgccacgggctatgtggtgcaggaagcctataaacttgattttattaacgatatggcagacagtatcggaaagagcatacagacccttgcaggtgtaaccgagaacggcttttcttctacgggcttctatgttggtttcctgcttctcattatcttagtggtgggaatgtatgttgcttatacgggactgattaaacgggaaaccagcaaggcacttcacgctgttatcaactttgtggtggtgttcgtgctgtccgcttcgtttattgcctacgctcccgactacatcaagaagataaatgaattttcatcagacatcagtaccgcttctttggacttgggaacaaaaatcatgctccccaactccgacagcgagggcaaggacagcgtggacttgatacgggacagcttattttctattcaagtggaacagccgtggctacttctgcaattcgggaacagcaacgcagaggaaatcgggacagaccgtgtagaaactcttgtatcggcaagcccagaggacgaggacggaaaaaccagagaggaagtcgtgaaaacagaaatcgaggacaacgacaacaacaatctgacgataccgcaggtcgtaaaccgtttaggcatggtgttcttcctactgttcttcaatttagggataacgatatttgtattcttgcttacgggcatgatgttgttcagccagatactttttattatctttgcaatgtttctgcctatcagctttctactttccatgataccgagctatgaaagcatggcaaaacaggcaatcgtgagggtgtttaataccattatgacacgggcaggaataacgctcattgtaacggtggcgttcagcatttccagtatgttttataacatttccacggactatccgttcttcatggtggcgttcttgcagatagtatgttttgctggtatctatatgaagctgggcgacttaatgagtatgttctctttgaacgctaatgacagtcaaagcatgggacgacgcatattccgcagaccatatctatacttggcacatagggctaggcgtatggaaagacggcttgctggtgcggttactgctggtggtgttgctggtgcggtggctggtagttctgttgctggcaaaagagctgaaagaaaaaatacagcttctaaagaaaatcggggcaataccacttccagcatgggacagcgtgcaggctcaaaggtgggtgctgtcttagatacgaaaaataaagtgaaagacaaggcaaatgctgtcaaagaaaacatcaaggatatgccgacacagaccgcttatgcggtgtattccgcaaaggaaaagggtcatggtctgctccaaatcaaacaggggacgctacgcttcccctgcgctggctaccgccagctacccttttgtggacttgccatctggggacaccttgcgttgcaagctgctcccagccgacaagttttacaaaatctctctatactttgacggtcgggtaaagtataatgaagttaacagcaaagcggaagttgattgtgagaaattttatattgcgaggaggaaataacagtgcttacattacaggaactccttaacggagtgaaatgtttagatgaaaatacactggctgaattgtcggataaattatgggaattggggacattagatgatataaaagaaaaagtgacccctgaactttttaccttgcatatttgtatgaatatggtggggaattggcaatgtgatggttggtggtatattatttgtgaacaggtaaaattagttccgtttatcccagaagcattaaatgctttaggattattcaccctgaaaacagcatttgaaaaggttatatcctgttttccccaagatacaatttttactgatgataataactatattgacaccgttaattttctgcaaaataacaggtttaaggtatcaaataaaaaattaaattcaatccctctcgaaaaaagaaaagaaatggtaaaaaagactcgtcattgtattgaagaattagaacagttaacagagcctttatggggatatgccagtgaaaataatgggtggaaaattgtgcttgactacatttccgctcataaataatataaattaaccagttccagtttgccacccacacatcgggtcaacttgtcctgaacttttacaacttaatacccgccgcccacacagcggcacaccaagcaggaaatctgaaaaaggtctcctgctttttttctgcccaaaatgaggtggtaaaacgccaccccatccgccaattaccgaaaggagtgacacgaaatgccctgcccacacaacgaaatcacgattgtgcagcgaagtcagcagcagtctgcggttgccgccgctgcctaccagagcggtgaaaagctgttctgtgaatacgaccagaaagtgaagcactacccggaaaagcgtggtatcgtccacaatgaaatcctgctcccggcaaacgctcccctggagtacacagaccgcaacaccctctggaacgctgccgaagctgttgagaagcaatggaactcccagcttgcaaggcggtgggtgctttccattcccagagagataccgcccgaccagtacgccgcccttgtacgggatttctgccgccagcagtttgtttccaaaggaatgtgcgtggattttgccatccatgacaaaggggacggaaacccacacgcccatgtcatgctgaccatgcgggcaatggatgagcgtgggaaatggcttcccaagagccgcaaggtctatgaacttgataagaacggggaacgaatcaagctcccgtccggcaggtggaaaagccacaaggaagatacggttgactggaacgaccgcaaatatggcgaaatctggcggcatgaatgggaggtcatccaaaaccgctatctggaagccaacaaccgcccggagcgggtggatctccgttcttacgaaagacaggggcttgatattatccctaccgtccatgaaggggctgctgtccggcagatggaaaagcgtgggattcagacgaacatcggaaatctgaaccgggaaatcaaagccgccaatagtttgatgaagtccatccggcagcttattaaaaatctcaaaggctggattgcggagcttagcgaaaagcggaatgaactgcttgcccaaaaagctgcggaggaagcggtctttcttcccaatctgctgatgaagtatatggagatacgaaaggcagaacggagcagctggacacgggcgggacaaagccgggggacttccaaagacttaaaggcagtcagccgttcccataagcagaatttaaaagaaaaacatatggagtttgtaaggaggatggtttaaggatggaatatgtgatacgctttgccatcagcctgtttgatctggcagtgtttatgtattattttcattccaataagaaaatgaaaccagtatcaaaggtatggatatgggctggatttaccattgctgcagttatatggacatttgtcagtagcataaaaaatccgtatctgaatcttgcgactcttttgattgtgcttatactgttatcattttattatgaatcaggaatgtggacgagaattataaatattgtgacattcatgggtattggaatgctgtttgaacctgtagccttgctgttactccatgcgatgaattttcatgtgggcgaaagttataaatattattttgtaatggtaatatgcagctttgttcgtggaaatgtgatgtatattctgtcaaaattgatttcaaagaaagggatgcagattgccgactttccaagagaaattttgggtgtgctggttatggtatttacctttacggtgttgaattgttgctttgttattcttttgtcattggaagctggcggtgaaaaaagcctgcttatgtgtgccagtattgtaatttccattgtcctgacagattattttatgctgtatatgatggaacgttttaattatcttgtgcaaaaacagtatgaggatgcaatgtacagggaagaaatgcactataaagacatctattatgaagaagcagaaaaacagaataaggaagtgcagaagttaaagcacgatatgaaacataaattgcatgaactgtatcatctggtggaaaatagtgatgggcaggaactttcagagaaaatcggtgcgatgtgcatggaatttgagcagatagatgaaaagcagtattctgataatccaatcgtagattctgtgctccgcattaaatttggcagggcaaaggcaaggggaataaaagtagaaacatctattcgtattccaaagcagatgcagcttgatcacggggatataggtgtattgtatggaaatcttgtggataatgcggtagaagcctgcagcaaggtgccggagggacagcgttttgtaaagattgaaaataagtaccagtccgggattttgcttcttataataacaaacagcaaaacaggaaagagaaataaaagcctgaaaacaaccaagaaagataatatcagacatgggcatggtgttcagagtgttcgtaaagtggtagaaaaatacaatggaacggtcagttttacagataaaggggatatatttgaggtttctgcaatgctctatggaattgaagtgaaggaataaatgcaaagcgttacacttaaatgtcaatctgttacactttgacggattttcctgtaaagtatgatatagtgcattcatcaaatgaaaaggaggacatacatatatgtcaaaattaagaaaattgatgaaccgactcagtcatggagcattaaccagcgtggcagcacttgcccttacggtaactgcaaccaatatgaaccgttgctgctggtttattttcggacaggacaagttaccggataatgcaaaaaaacttagaaaattttaaggtggtaacagggtatgattgctaaatttgcaaagaagataaatgaaatattgatacaaaaggggattgtgcaaaaagaggatgcagaactgtaccgatatggtatagaaaatggcattgttgttgcaggaaaccttttggcttctggaatatttggcattgtgacggggagaccgggacttgttctggtcttcctgttattttatgcctcgttgagaagctatagtgggggcagccactgtaagagtagaatcggctgttttttgatatcaatggcaattctagtgtgccgagcatggcactaatcttactggtgaaagtccagtcacgggtatttaccgccaagtgtagtgaaccacaagtcggtaccagtaatggtatggatgaaggaagtggtgtaacaaagttcttgagcctacgtacagaaacttgataaggcgattaggtgggtaaggttgctagacaaaccaaagcccaaaaggtaaacgtaaaccgaagttgtaaatcaagaggttgtggaacgaaagattagcgtcttacctcgggagaccctactcacatactgaaaggtatggtcgaaaaaaggtttagagagggagtcagatgatgtcatagtaggcgaaagccgaaggactgaaacgatttatagtacgaatcgttatgtttaaaataatacatgagccagaaatcgagtggacaggaaaagtaggaacgtaaccgaggaatactgtttatacttagaggggtgttatgtatgaattttaggataagtcagaggagtaacaacaatggaattgattgaagtgatcttgtcaaaagaaaatctgaacagagcctataaaaaggtagttgccaataaaggtgcgagtggtgttgatggagttactgtagaagaactgggagattatataaggaagaacagagagaaaatcgttacatctcttagaaacagaacatatataccgaaaccagtccgaagagtatacattccgaaagacaatggtaagaaaagaccattgggaatacccacagcacttgacagaactatccagcaggcaatagcacagcctatatctgatatttatgaagagatattcagtgactatagttatggattcagagccggaagaagttgtcatgatgccattcgacaggcattggaatacttgaatgatgggtatgaatgggtagtggatatagatatagaacagttttttgacaaggtaaatcacgacaaattaattcagatactaagagaacaagtaaatgacagtaccacattaaatctgattcggaaatatctgaaagcaggtgtaatggaaaacggcttggaaaaagcaactattaccggcgtgccgcaaggaggtcctctttcagtcgtatgttcaaatgtctacttggacaagctggacaaagaactggaacatagaggactccgctttacaaggtatgcagatgatgtattaattttcactaaaagtgaaatggcggctaaccgggtgatgaactccataagtgattggctggaacggaaactatttctaaaagtaaatgcaacaaaaacgaaagtagtcagaccgatgcgaagcaaatacctaggattcacatttctgaaaaacggtggagagtggaaagtaaaacctaccaatgaaaagaaaaagaagcttaaaaagaagctgtgtgaatatctgaagagagggaaagcaatagcaagacctcttgtggttacaatcaagcgagtaaatgagattgtgcgaggatggattaattactttagaatcgggttgatgaagcaatttgtggaagagcttggacagtggctaagacacaaaataagaatgatagtcatgaagcaatggaagaagccgaaaaccatctacagaaacctaagttatctaaactggaagaaccgaaacggatacagtcaggaagatattcataaagttgcgaattcaagacttgggtggtatagaagaagtggaatgaacgtggtgaatttcattatcagtaaagatttacttgaaaataggataaaagatggagctggtctgctcaatcccttatcctattacttagcaaaagttggaatataagttgtagagccgtatacgagatccgtacgtacggttcaatgggaggggcgagataattattctccctctaccctattaatacccgtgactggactttcaccagtaagattagtgccatgctcggcacactagtaaaaaaacctctgggcgatttcctcgcccagaggttttttagtaattggttaaattacttggttgtgaaagaaagtgaaatattaacttccttatctacatatccgatagtagttccgtttgcatcgtggaaagcaactcttaccgtaacctttgtaacatcaacagtctttccagaagctaaaaccgtattcatgttggatgcatcaactttaccattggtagctcttacaccatttgaatatccttctacagcaacaatccgagcggcctggtcaccatctgcaccatacttaactccgtcgtaagagtactggatggtagatgccagtgaagcctgaatagaagatccagatgtaacactagcatcttttaacttcatatcggtgattgcatcgtttgaagaatctttgataacaaatgactttgtaactgtagtctttgtatccttagatccgtcagcataagcagcatctgcagaactatcatgttttggagtaactacgattgtaacagttacagtatatcttccctctgcaagcttggtaaataaagttccattctttgctacaacatctactgtaagctgatcaggtgtaccattattaccagcatcaaatgcagatccggtcttaacagttgtatttggtacgttgttgtatacaacatcacctttagcattctttacggtgtagtagattcctttaacattacttgcagtctttgaagctgcatcagcaactgctacatcatctaagtcagcaccagcggttaatttcttcttttcaacaccctttaataattcagaaacgctaacaacaagctgacgtgcagatgtattatcagcatttacaacagcatcttcttctgtctgtgctgcaccatttgcattgttaatatttaagctataagagatagaatctccagctacaccggcttcctgtacgttaacagttacaacctgtgcacatacttctttaccatccttcatgaatgtgaatttgaaagtatatgttccctttgttgcataattagaaccaacaaatttgtatgttgttttgcttcctggtgttcctgtctgagtaggtaaaacaactgtagatttagttacaccatctggagcaccttcgcaagacacgctgatgtttccgttatttccacttgtatagtcaaagttatttccatactgatccttagtggtgaatgcaacagtttcagcatttgcaccagctgcattagatacaattacgctagtcttatcagcgctcattgtaacaacttttcttgtagctacaacagttacaggtacagaagcaacaatcttgtcatcttttttaataaagatatatgcagttccttcttttgctggaacgagctgtactttattattcttctgcattgtatttccaaggatcatcagtgtagtcttatcactagactcaacagtatattctccatagttagagatttcttttccatcagtatctttgatttcaaagtaagcccatacagcctttgtttcatctacagcaattttatcattgtcctttaaagaactgaatttcttattgttctcaccaattcttaccttgaaagaacttacagcagcctgatcagtagctgtgattgtgagcttatttggtccgatgtttccatctgctttaccatctgctgtgtacttatttgtcttataagtaatctctgctgttgcagtgtcaccaactttatttaagtaaagtttagaaccatttacatatccgtttgctgttgtaagtgagaaatcatagtttacatcagatgttcggggctgtaaaataagtccctaatataagaaacgccaattccggcaaatgtcggttttggcgtttctttgtattaacttttctatttctaagcaagtctgcatctttgggtataaaaaatggtgcatttaataaagctcggctaatcatgcccgcttaagttttatgcaactttcgtctgtcgttgctttttgttgtgatatttataaagattgaatccacatgaaatcagtgtaagctcgagaattacatttttctcgcctcttcgcaataatcttttatacgctttatcccactttaatacaccaaaagttccctccgattgaatacttcggttcattctcaagagagcaccatgtatggattcaagattttgcagcacttcctgatggatagcagttaattcctgattcattcggatcgttcggtttttgtgtgttctcggacaacattcctgtttatgctgacacccttcacaagattcacattcgtataattcttccgttcttccatatttattatatttcacatgctgtgttctcttgaagaggaattttcgaccgtttgggcataaaagatttccatctgcatcttttgcaaagtttacagcacgatacggattctcatgatactttttgtccgtcgtttcttttttgtacatggtaaatttcatgtatttttccatgccgtgttcttcacaataaagataattattgtaagaaccgtatccggcatcagcaaccggatatttcggatagtgaccatatgtgcgattgaatttttccatcaaaggaacaaagcattccatatcggatgcatatggttttacgtcgattacagctatgtattcatcacagatggctgcctgtaggttgtatgccggaagtagctgatcgtttcccatgtaatcacgctttaaacgcatgaaagttgcatcatgatctgttttggaataactgtttctttcttctccacaggtctcgatatgatatgcataggatttcaaacgttccagatattcatgcaattcttcgtattgtttttgtcgaatgctttttctatgaccacgtccggaaacgaaagaagtttcatccagtccggttgtttctttgtacatcgtaagtaattcagagacatagtcaaccgcgtacgcttcacgcttttcaaattttattccgagatatccaagtacttcccgattcatagcatcaatcaagagtgaaatcttgtcaaagactttctgccggtttttcacacacgattttttccatacccaggtatatcgattggcatttgcctcaatttttgtcccgtcaatgtatgtatgctgcagatccacgtgatctttagcaaaaatatatgaattaatgtcttcaaatatctgctcgatagaatcggttagttcgtttcggattaagtttccaaatgtagcaaaagaaggcgttttcatgccatcaagaagatacatgtaacgaatgtcataacggcagagcttttctatttctcgtaaggagcagatgccattttccataaaggcaaaaagtattactttaaggagtttttgaacatcacatcttgggcgacctgttttatagcctttctctacaaaatatctggataggtcaatgtgatccataacctcacaaaaagtgtatactggatcggaaatatcgatcaatttttcgatttctaatggtaatttcagctgacgcatagtataattaccattggtattgttatttagtagcataattaattataccaaaaaatcgctcagacctcacggtctgggcgatttttctgtcaggggagtttttttacagcccctggagcaatctggtgatatgtcaagatgatttttgaaaagatttcgatatgtttttcagaaaaagggtaactttaatagacctatgattcaagcaaaacataagttcgactagttagaatctttaattgatgtatccagcgatacgccggagtacaattggtttctggccagcaatccataaaccaaacgaacgaatttacgtgaagtcagcgcgagtgctcttttgtgttgatgtttcggaacttcattgtacttcttccgatagtacgttccgtactcaacgttgtgttttctcatactgttggcagcttcgccaagatagtatcgaagataacgattaccagcttttatcataggagtatcttctccgtcgaaatcaccggactggttggatttccatgtgagaccggcatacttggcaagagcatcagatgaatgaaaagcggttatatcgcctatttcagcaattatgccaccagcaaagacaggaccgatgccgtcaatggattgaagaataataaaagcatttgggttcaatccttttatttctttttcaatagcattgtcaatgactttgatttctcttttaaaggtttcaatgcagttgaaagaactggcaatagacacatttaaaggctcataaagagctttgtccagacgataagaatctctggcagctttctttaataaatcagcggtcttgcttatgtctttaatgcggttgcggcttttctttgcaaggaatgcaatcagatcttcttcggaagaatctaagatttcttccggggaaaagtattccattaatacactggaagatgtagcaccatatatatcgcagaaaggctgatcgtctccttcaagcatctgcaattcactgaatttcagataaagattggaaacaagataagttttctctcttgtcatgcattcaacaaggtgaaggcgatgccgtgtgagacgtttcaaagccaggaactggctgccacgccaaggctcggattcaatgtttccagctcttgcatagtctgcaataacaaaagcatcgataggatccgatttaccaagtcctatatagcttttcttgtagtttgcagtacatttagggttcaggacgaaaacgtaaggcttgaaccgcatcaattcttcacaggaagaaagataattagcgatatggatgctgtaaacagaagttgattctaaagctgcaacaatcgtagttatatcagggtgttcttttaaacactcaagtatcttcaatgctaattcctcagccccaggctgattgttagcaaaagaagagtttatgtatttatttttataaaaatccaaagcgcaaacatagttggattttgaactgacgtcaataccgacgtaaagcgtagataatgggttaatctttaacatgatatcacccgcctttccgattaagtattcttggaacctgaagaaaaaggtttatcctgggaatcatatgctgaccgaaacctcgcgtaataagcatgcaccctggcagctcttttgctggtgctgtacgccaggggatgaaacatctgtgtaagcggaatgtgacatatgattcaggctgcaagctccataagcaggcaccggagaccgggctgaaaggattaaaagcagtgcctctagacatcagactctgctgatatcataccacagaataacctatgaaactaataaccaatgtagatgagatggaaagggtttatcccaggtgtctcagatcatctataaatttatagaaaggataagtgcataaccatcatttctactggctatacacttattatacgaggattatatccggtgaggagttattttaatttggtaacaaaaaatgccgtatttatgcggtctgtggcgtttcgcaaacgcctaaattaggataaattgtgaggtgcttatctatgaaagtattagttagttcatgtatcatgggaaaaaactgcaaatataacggtgggaataatctcaatccgaaagttgtagagtttctaaaagacaaagaggttatcgagatttgtccagaattattagcgaatatgcctacaccacgtcctagtgcggaaatagtaaatggtattgtcatggatataaatggaaatattgttgatgaggaatatcgtcatgcggtacagttggctttaaatgaaataaaaagtgtggaaatagacttagttattctgcaatcaagaagcccaacttgtgcagtcaaaaatatttatgatggtagttttacgggaaaattgataaaaggtcaaggtctgtttgcacaagcgttaattgaggctggatataaagtgttggactcagaagatttttaatgaatagtaatgaaaaagcagttagtcttaggattgactgtttttttcatacccagaaaggagtgattgatttatgcgtaagatttggaacaaaggacaccgtatcagagccagcgacaaacaccttgtctatcatttttccatagggacgcttctgtttgtattcgtggcggttctcttgttactcaatatcaaacagctcatgtgtaccgattgggagcatttcagcttgttagagaacggcttgacgctttccccttacaacttcataaccatactgatagcgactggtgtttgtgcattggtcgcttttctatattaccgcttttgttacgacggtttcaagaagctcctgcaccgtcaaaagctggcaagaatggtactggaaaataagtggtatgaagctgataccgtacaagacagcggtttttttactgacctgcaaagcagatcaagggaaaaaatcgtctggtttccaaagatttattatcaaatggaaaagggactgcttcatatccgctgtgaaattacgctggggaaatatcaagaccagcttttacggttagaggataaattggaaagtggcttgtattgcgaactgaccgacaagaccttacatgacggttatatcgaatataccctgctttatgatatgatagcgaaccgcattaccattgatgaagtacgggcagaaaacggctgtcttagactgatgaaaaatcttgtctgggaatatgacgcactccctcacgctctgattgctggtgggactggtggcggtaaaacgtattttctgctgacgctcattgaagccttactgcatactaacgctgtcctttacatcttagacccgaaaaatgcggacttagcagacttaggaacagttatgggaaatgtgtatcacaccaaagaagaaatgatagactgtgtcaatgccttttatgagggcatggtacagcgaagtgaggaaatgaagcaacacccgaactataagacgggcgaaaactatgcctatctgggactgccaccctgctttcttatctttgatgaatatgtagcattttttgaaatgctggggacgaaagaaagtgtgagcttacttagccagttaaagaaaatcgttatgttaggacgacaagcaggttatttccttatcgttgcctgccagcgtccagacgcaaagtatttctcggacggtatcagagataacttcaatttccgtgtgggcttggggcgtatcagcgaattaggttacggtatgctgttcggttcagatgtgaaaaaacaaaagggcgtgtgaaaaaacgaaagttttttcatgcgtccttttgcttatagatacaacagtagttatattttataaaaaagtgtatactccccctttccccataagaatgctattatggaatcctatgcggcagttgcgacttttttctgtttattgtgatatttataaagattgtgtccaatagaaacaagaaatacttcaagcaatacagattttatccctcttcggacaattcttttataccaacggtcgttttttatgataccaaatgtaccttcggcctgaatggatctgttcatccttagaagcgctcccttgatactttcgagattttcaatcacttcctgatgcatcgatgtaagttcatggttgagccgaacggtacggtttttatctgtctttttacattgttctgcatatggacagccggaacaatcttcacactgatatacttcttcctgtcgtccatacttgtttccctttacatttttacgatactgaagataaaagcttttcccgtttggacaacgcatgattccgtcctccccgattgggaaatttactgcacgaaatggatcttcatgatacttcttgtcagtagtttctttcttgaacatggggaacttcatatatttttccattccatgctgctcacagaagatgtaattgttgtaagaaccatatccggcatctgcgactggatactttggatagaaaccatatatattctgaaacttgttcattagtggaataaaacagtccatatcggaacggtactgatttacatcaacaacagcaatgtattcatctgcaacaccaacctgtacattataagctggaagcagctggtcatttcccatgtagtctgtcttgattcgcataaaagtagctgaatgatctgtttttgagtagctattacgatcttctccacagatcctgattttttctacatattcttccagcttggcagtatactccctgagtttctcataatgacgttgctgcgtagttttgcgatgtcccctgccatgaacaaacatcgtttcatcaatctgccagacttctgcatactgttcagcagcttctttcagatactctggcgcatactcgctattgatacaaaactttatacccgtacattccagttccttattgatttcctcaaagagtgtggtgatcttatcaaatagacggtatctggatttttctgttgattttttccatacccaggagtatttattcgcatttgcttcaaacttggagccatcaatgtataggtgttggagatccacgtgttctgtctcgaagatttttttgtttatgtcctgaaatatttcttctatggaatcagcaagtacctcgtttataaagtagccgaaggtacggtaagaaggtgtttgatgatccatgagatacatgaagcggagattgactttacactgatcctccagctcacgtaatgatatatagccatttgccataaatccaaacaaaactgtcttcagcatgctgaccgggtcatatctgagtcttcctgtatcatgttgcggaatatttttcagatatttctccagttcgatttctcccataaatctgtcaaatgtcagcaccggatcacagatgtccagataatcttgaattagtattggcaaaactgcctgttttgggttagaatagattatgttattaattttcattgcaagttaattataacagaaagaaagaccttgagttcattataaactcttggtctttcttttttcgggactattcttttttcacagccccaaaaaagttgttgacaacgacttgaagatatgataaaatatacaagctgttggaaataacaacaacgaacattgataactgaacagtgaaaaaccttgaaagattttgagaacaattcaagaacgcttctataaagaagcaaccttaaaacagtaaatcaggacattgtttctgattaaaagccagatttagttctggcaggacaaaactttttaacatgagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggattgcatgatccggtgtgaaaaactccggtggtatgggatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagtatgtaatgtgctttctcttcggagcatcggtgacaggtggtgcatggttgtcgtcagctcgtgtcgtgagatgttgggttaagtcccgcaacgagcgcaacccctgttcttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaaatcgagtagggatttttcactgttgagttataccagtatgtgcggtttgttgatgaagaaccagacaagcgaaaaaatgactggaagctcaatgaccgctgggcttggtttatcggcgataacagacagagcttgaaactgacgacaaagccagagccttacaccttagaacgtacattgcgttgggtacaaaggcaggtagcaccaaccttgaaaatgctgaaaaagattgataagggaaacggtacagactacatggaaacaatcgaacagcaggcaaagctcacagaaaagcatgaaatgataatcaaacagcagacgacccctgcaaaagatttggtggaaagttaggagtgataaaaaatgtgggtattagtaaaagacttcctgctggtatctatgggaatgggtatcggcgtagtcttgatgtgtattttgaatgtcggcaaagaagctgactgtgaaatgaaacaatgaaaagaaagcgaggacaattaaatgaatttcggacaaaatttatatcaatggtttttatcaaacgcacagagcttagtgcttatggcgatcgtggttatcggtatctacttagggttcaagcgtgagttttcaaagctcattggcttcttggtagttgccttgattgctgtcggtttggtattcaacgctggcggtgtgaaagatgtactgttagagctgttcaataagattattggggcgtaatttaaattcctcctttgtcgaaaaactattttattcatttgtacaagataaaggtgtatgatatactataacacaaataatctaagaaaagaggaataaaatgagtagtatagatagtgatgtaaaatttccagatatgaaatactataatatgagtaaagcgggtgatatggcattatatctagctcattgtgatttttacccttttagaagtgtgattgaaaataacaaaattgctttagatgcgatagctgaaagttatcgagatatagcacagcaagctcgtcaaaatgatgattttgtaacagaaagttgggcaatgacaagtggttcactccatagttgtcgtgtagaccttttaacacaatactccttattattaacaatggtttcattattagaggaatcagtaaatacactttgccgaatatatcacgatactgaacatcttacaaaagagttaaaggatataaaaggtagtggattagaaagagccgctaaatacctaaaaaacgaagtaaatattaaggggttttatgaaaataagaattgggaatacattacaacaattcgtgacgctagaaacatggttgttcataatggtggtaggctaacaaaaggctttgagaaatttgataagtttggaattggctaccgtgaagaagataaacaactttatttggaatatcaagatattgtaaaaatgtacgacgcaattatggatttcatggaagattcttttagaaaagaaccactataattattttggttttataacacgtatatcagcagtaaatcataacggtttactgcttttttcttaccaaaatttcagattggagtgatgaaatgaacgatatttttaagaatatgcagtcaaaagtcggctgtgattatatttctgacctgccctcttacaagcgtaaggtatggcatgaaatgaaacgactgaaccctgccgactatgaagaaaaacagttagaagatttttctaaatatgtgtttagtatgtcgtaccagaccataaaagatgtgataaaacaacagaaaggacgtgaggaacaatgcaggaaacaagggtgctggtggaaacgcgagtataagtattatgatatggatgctgtgattgcttcggcgctggagctggcagagaaggaattggattaggaaaaacaggaaccgccccaggtgaagacatggggcggttcggcgttacatattatttgttttgcttagcaagtgcagcttccaattcagcgatacgagaggcctgttgatcaatggtttgcgtcaactgtgaacagacattgggggcagaccctttgaaatactaataaaatgagtaaatatgttttaaaagttttctaaagaaagtataacataaagaaattacgaatctgtatgtgttaaggatgctcagttaaagcaatatgaacacaataaggagagatatgaacacaacattacttatcatggctgctggtatcggtagccgtttcggaacaggaattaagcagttggagccagtggatgatactggacatatcatcatggattattccattcatgatgcaattgaggctggcttcaaccatgtagtatttattatccgtaaggatatcgagaaggaattcaaagaggtcatcggtgatcgtatcgcagctatttgctctgctcataatgtaactgtggattacgcttttcaggacattaacgatattccgggaactctgccggaaggacgtacaaagccgtggggaactggtcaggccgtgcttgcagcgaaggaagtaatcgataccccgttcattgtgatcaatgcagatgattactatggcaaagaaggcttcaaggccgtccacgagtatctggtaaatggcggaaagtcttgtatggctggctttgtgctgaagaataccctgtctgataatggcggtgtgactcgtggtatctgcaagatggacgaggataacaacttgactgaggttgtggagaccaagaacatcgtaaagactgcggatggagcagaggtagatggtgtggcagtcgatgtgcattctctggtctccatgaatatgtggggcttgactcctgattttctggatgtactggaggacggattcaaggagtttttccagaaagaagtaccgagcaatccgcagaaagccgagtatctgatcccaatcttcatcggtgagctgctggagcagggcgagatgtctgtgaaggttctgaagaccaacgacacctggtacggcatgacctaccatgaggatgtcgcagccgtaaaggacagttttaagaagatgttggcggatggcgtatacaagactgatctgtttagtgatctgtaaataacgatgaaagaaacgattgatttactcggaaagatcatcacaaacatcctgactgctctctatgaactgtttggattctcactccttttttccttcctcgcctcccaaaaagcaaaaataaattagaatagcgaatggcagggaaaaagtcaagaattttttgaacatgagagataagggtgatagatatggaaaattcattatacatatatcatatggtggtgcctctgcgctactatacttatgatttacatagtgagaaaaaagactcggaatatgtgatgggattaaagcaggatattctttggattatatgattcatgctgccagcaatgcatattcatatttaattcagaaaaatccaattgaaacaatgcaggataatttttgaggtttgatggagttattgcaatattgtgtagaccatacggttcaaaatgctgtatatgtttcttcaagtgaaatatatggcaggaaagacaataataatccatatcaggtgatagttgctgcactactgaatttatgtggaaaaattcagacaaaatgcagagcttataaaaattgaaaaaaatagaacaaactactgacataaaaggaaaggtggaaattttatgaaaaatagaaagaagatggcaggaactattgctatgattatggcgttatcgttagggtataatgcaggtggtcctgttgtagttcatgctcatgaaaatgcagtgataacagaaaaattaggtgaaaccgcagcatcgcaggagggtgttattgatttttctgcgataaaggataatgaggatttagaagttgcagattatttgccttcggatattaatgatatggaaaagatttgtacagaggactattctgtaaatttggtagatatggcggataatactgaagataataagacagtaaatgataatcctaatgatgcaaaagcaatatcattaggaacacaggtttatgatacggttgcaacagaattagaacagcgttggtatgcatttagcgttgcaaaagcgactaaatttacagcggcaatggtaatggatgatacagcggattttgatttatatgtatataaattaaatgaaacagatggaacattagaacttgtgggtggaagtgcaatagtaggagccggaacgcaagagttatcaatgttaaagcttgatgaaggtatatattttattggaatagaagcagcgacaggaaatggtagctttttaatgtatacatatgcaggagttaatgacggcaaagaaatcaatgatacaacagacttggcgagttcttatgtgagaaatagtcgtatgacggctacgattgatagtccatttgattatgattattacaaagtagttattagcaaaaatgatattctggaatatacttttgaccagccaacaggttgtgattataaggtcttagtatatgatggaaagaattattatacaatcaataatggcacatacagattaaatacaggtacatattatttcattgttatggctagttctatgaattatagcgatgacaaatattatggaataaaatttcaaaagtacaaattggcagatgatgaaaatgcgaaatatatgtggtatacaccagataaggcagcaatttttcagtttgacggttcaagaacaaatttttatgtaaatggaaatccgatagattttacttatgaaagaactgttaagtccaatggaaatatttactttaatttatataaaacaaaggatcaaaatgttgtcttatttcaatcagaagctatgcaggtaatgcaggaagttccaacatttatcaatgtaagtgcgcctttcagcggttggaattcctataaaaatgcccttgttgtgggattgtttaatactaattggagagttaatagtttttcaagtaactatgatggtctaacaagtaattgtgcaacagtaattattgattctgatacaggaaaagttgttgatgtaatgacaccaaacccattatatgacaatggagtggttcttcattggacaagggtaagtggagtacaggcaaattacaattatgatccagtggattaggaggctgctatgaagattcagagtaatatgtatattaataatcctgatatgacaagtagaaatattgagaaaaaagaaaatagttctcatgctttggttcaggaagatgatatacaaatcagtgattcagcaagaaagttagttgagactgctcgtaataaggtatcggaccctaaaatgaaaaattaaacctgtactttgacaactgaaaatggctataaaaggtctagtttactttttctacagccctttccaaggcatgatatattggttatatcgattactatctgctgggaaaggagcagatatgaattattacaatgctagcggacaaatggacctgtcagatcgaatagcaatagaaactgggatatgcatcggggagtcattcaaaaaaatagcaaaaagacttcgcagacatccatctactattgcacatgaagttaaagaaaacagaaccttcattaaaggtaattacccgaatggaaaagattgccgcatggcaagacaatgcacagtaaggaatttgtgcggctgtgatgaagaagcctgtaatacaaagtgtagactttgcagagaagtggattgtaccaaggtatgcgatagatatgtatcagttgcttgccataagtttgattcgcctccgtatgtttgtaataactgtaaggataaaaagctttgcaacaaagataagtatatttacagtgcgaaattcgctgatgcagctgtaactcgtcgtagatcggagagtcgacaaggagttagactttctgatgaaaagaaggtagaattggatgaacttgtgactcgacttgttaagaaaggccagcctttaacacacatatatgcagaacatgaaaatgaaatgccagtgtgtttgagaacactttataactatatcgatgaaggtgccttatctattaaaaacatagatttaagaagaaagacaggctacaaaccacgaaagaaaaagtacaacgatatcaatggatttcactcaatggagtatagacagtgtaggacatatgaggattttgagtatgcgatgaaattcaaatattcagaagatgaagtaacagaaatggatactgtaaaaggcgttagagaatctggaaagcgtttgcttacaatgatctttagaaagaacaacgtaatgctactattcctgatgccagatggaaaagcagaatccgtaaaaagggttctggactatctcgagacaggattgggaatagatgtttttagacggttgtttccggttatattaactgacaacggcagcgaattcaagaaggtagatgagttagaacttacgctggatgaggatggcttcctagtttatagaacaagcctttattactgtgatccaatggcttcatggcaaaaagggtgtatcgagaagaatcatgaatttattcgttatgccgtgccaaaaggaaaaagcttaaacccatacacgcaagaagatatgactttattaatgaatcatatcaatagtgtaaaacgtcctggacttggaaataaaagtccatacgagctcgtagaagaggatgatgaagatttcaaagcattaatgtcattattaaaaatgcacctcatcccgccagatgaagtgcatttaatgccagatttattcgttaaaaagtaattagaccgaagctgcagatagtaatcgatttgtcaataggtattaaatagacgggtcgcatttacttttgcataacaagtagccagccgtctgttaatcatgcaaacaaatatatacctgctatctggaatgccttaattatagcatgatatttgaatttgaacatccattattagggctttatttgacctcagaacagaattttgattattagacgtattttcagttgggttttagtttttcattcaaggagcggttgcgtatgcgtgcctgtataaagtattgccaaatcatgtggatgagattcaggcagaggagattaccattacactgattcgagaccgcaagccagcgaagcttcttcagaaattaagtagtgatgggtatgaatgcaggaaagaaacagccggaatctattatgtcagtggtgtgatgttcccggtgcagatcattgcatcatcggaactggatatggatttgcatgtacagctcaaggcactgactgacaatttggatgaaccgctgatgtggaagtatctgcaggaagttagcgtttttacagagagggaaaagaatcttgcggatgttgtgcttcaggttattgtaaacagtaacatggagaaagtgcaaaaatggaaaggaagtgaacagacaatgtgtgaggcattacgtgttttaatggcagatgaattgaatgaagaacgcgtggaaggtcagcgtgaaggccagattcgtgcatatgcaactttggtaaaggatggaatcattacagtggaagttggtgcagaaaaagcaggaatgtctgtcgatgactttacaaaagaaatgaaacaggctggttatgtaatccctgcggtataaaatcattttgtaaagccatgtagtatgtatgggtaaaaacatctataatttcaattattctgcggattcttgagaaacagagtctttctttttcctggattttgcagaaagcattttatgaccagagtagatagccataatcatgcagagaagagaactgcaggcaaaatatttgtgagctgatttcatatttttatagccggtatagatagttccgatcatggttgccaatgcaccaagggaccaatatttatgtgctttcatttgaatacctcctgtgtttttctatataatacctctttttggagagtatgcaaacaggaaattttattttatttgctctgaactgtttttctgatgaggcaatatttgttagaggtcggtgcatttgcagagagggaaaaggatcttgcggatgttgtgttgcaggtcattgtaaacagttacatggagaaagtgcaaaaatggaaaggaagtgaaagaatcatgtgtgaggcattacgcgttttgatggcagatgaattgaatgaggaacgtatggaagggcagcgagagggcagaattgaaggccagcgagaaggaagaatcgaagggcagcgagagggcagaatcgaaggccagcgagaaggccagattcgtgcatatgcatctctggtgcaggatgggatcatcaccgtggaaacgggtgcagaaaaaacgggaatgtctgtcggagatttcacaaaggaaatgaagcaggcaggttatgtaatccctgcggtataaaattaattttgtaaagccatgcagtattggatttttcattgcatggctttttgttttcctacttgaaatgttttttcttgtagcgggcatacacatatgatatagtaatcatatcttttttcagaggcagtttctgccagaaattccatttgtttaaattttatgagtttattaatacgtgatttttgtgcgttgaaaagagtataacagttttgtataataaaaggagaacaattgaaaaataaaaaagaaaaacaaaagaagctacagtggcatccggcattctgttcagccttgcgcctggaactgctggaggatgcaggctcttttgactccgtccagtattgcttactttctgcatgaacgggtgtagtcggcaaagcagtaacgacagttgcaagagctaagaagcccgtacacaatcgttttaacatctttttcataaatctaatgctcctttcatttttggtaataaaataaccgtccataatgaacggctgaaaatagaaaaggaacgtcattttaggcgttccatagtctatgagttattcaatttttcttgtttcaatactgatgtgctgtaccatatctttgcatatctaggaaaacttgcgtatcaaggctcattcaatggtagtaaataagtagtaaattgatgtgtttgtttccttgaaaatgctgatagatactgtgttttagcggataatcagatttttattgtgttttttacttaaaaatttaacaaataaatgtgtatgattgacacgataatataaatttttacacacgaaaggaagaaaaatgagattaccaaacggatacggcggagtcgtaaaactctccggcaacagaagaagaccctacgcagcacgcatcactacgggctggcacatcaatgacatcactggaaagcgcatccagcactatcagattctgggctacgctcctacccggtcagaagctctgcagattctggcacgttacaacaattatcccattgatggggaaacgctgaaattaaccttccgggaaatttatctccgatggtccgaagaaaagtttcctaccatctcccactccaacatcaaaggctatcgggcggcctttgccacttgtgaaaacattgctgatatgccatttcacaatttgagactcaatgatttacagcaggtgattgatcacagcggcaagaactatcctaccctgaaaaaaatccgtgttctctttaaccagctctattcttatgccatgaaacacgaaattgtctcaaaagattattctgcctatgtaaatatctcgaaatacaaagaccggaatccaaataaaaacatacgaagctgtttttccacttctgaaattgctctcctgtggaaacacaaaaacgatccctattgccagacagtcctcatgctgatatacaatggggtccgtgtctcagagcttttggatctgaaaaaagaaaatgttcatctgtccgaacaatattttgatgtcattgacagcaaaaccgaaaacggcattcgaaaggttccgattgctgacaaagtactccccttttaccagcgctggcttcatgactgttctgattgtgaatatctcatccatactctggacagccagcattttacctattatatgtattaccacaatgttttccaacccctgatgtttcgtctgcacatcgatcatacacctcactgctgccggcacaccacgatttccctgctcgccgaagcacatgtcgatcagacgaccatcaaaaaaattgtcggtcattccggcgctatgtccctgacagaacgaatttacacgcatctggatgtgcctgcgctggtcgaagccataaatcagatttaatcgcttcttgtatgttgcttgcgtgttacttgtagaagtgattttgccccaaactctgtttataaatccggtatttccaatacttccgtggaaaataccatgcatatttccggttaaggtaacttacaagacttctacaaagaagaatgctaaggcaagaattgagcatagcatgattttaatgacgaaaacggatattgagctgttttaggcgcacttaaataagccgtagactttattgagttggtaagtcctaagcaataagaggttttaagctgcgaataaattcgtgatgattgattttatccgaaagtacaactgttatcagttgggtaattcctgcaaggatcagatcggcgtgaagtgttttctcattctgagttcttcttccggccagacaaagattatccttgatgtggttaatatctctttctacggtggttctgattttgtaagtgttattccattcttctgtaccacggatagcgccaggataggcacggagatccttttcaggataaatatacaccattctgccacaagaagaagctgtacatggatcatcacatgtacagtgacgctgggatctgccagtagatacatttttgatccacttgattttaggacagacaaacttatatctggtaacaccgcttctgagttttgatattccttcatatttcatgggaagtgaatcatcatgaggacagcagggaatcccattttcattaatcgtgtagtcctgtttttcaagaccagccctggaattcagagggatataagctttatcaaagtgtttatgatctccgaacgtattaccggtaagaagtttgggatagagtgccgcagtatcaaaagcagcatcgccaagaaaagttttgggattaatcaatggatgctttaaaaagaaatctttcagggttggaattaaaagcctggaatcatggacagacttgtcttcatcaggtgaatcagatttcttttcaacggtaatgtcaggatgggaagctataaagtttttgttataaaaagcgatatgcctgatgattccaagaccgttggtaatgatgccaaatttgaagacataacagaaatgcccattgatgtataactgtttaatttcaggattagcagacgcgtgcgaaggcatagaaccataagcggctttataaggatcataattcttgtcgaagctgttagcttttgcataagccttaagctgtctgataatgcggttagcatacttgggattattctcagtaacaaaagcttcaatgcctgaagaatcaaagatggtcatatcggcttttgcggaatcaacagcctgacagattggttcggtgatatcaacaagtttatcaaaaacaagctgcagatcatctaaaaagtcctgtttgaagcgtgtaatcttagaggcatcagggactttggtaaaaccgcagaaatcacgaagcggtttcgagtaaaccagaaaagttaaaagaagctggtctgtagggattgagaagatacgctggataatcaaagcccacaggaaagcacgtaaagggtatttacgggatcttcccgttgatgcatagaaatgatttctaaaagaaatcggaataaactcatcaatatcgatatgggtttctaatagagaaagaaatgcaggcttgtcattattaaatttattttggcaatcttgaaaaatatctgccaaagaaagctgtttatatggtatcatatgtatcagaataactcctttcttgggtacatggtttgtagtttttagtcaactctattataccatatccggtgaggagttattttaatttggtaacaaaaaatgccgtatttatgcggtgaaaattgcaaagtttaattctaccatccatttatacagtggaattctcttctgcacaagtggagtttaatctttcatatcataaatggtatgctcatgttggccttctgacagcagtagaaggagaactagcatgagcaaatatattcccggtaatcaaaaacatcttactctcgaagatcgcaaatacattgaaaaatccctaaacgctggctgttcttttaaggacattgcaagatatctttgtaaagatccaacaacaatctcaaaagaaatcaggctgcacaggctcagcgactggtatcacaaaggctgttttaacaatgcacataacttttgcgtccacagatatcattgcaaaaaagtcaatgcctgtggcaagatcattctctgcggtgtcaaatgtaccacctgtccaacctgcaaccagacatgtccggactttgtcaaagaacgatgtaaccgactcgataaagcaccttatgtgtgtaatggttgtccaaaagcaatcaatcactgcacgattgcccacaaataccgctatgatgctatttttgctgaccgcaaatacaaagaatgtctctcacagtccagggccggtataaacatgaccagacacgaactgcatcagaaagatatggtcatcacgcccctgatttttcagggacagtctccatatcagattataacgaatcatccagaactcgatatgtccgtgagaactctgtattcttaccttgataaaggaatcctgtccgcaagaaacatcgatctgaaacgtcaggtaaaattcaacccccgcaaagtacacaagacccagatcaaagacagatccgtttttatcagacgtatgttttctgattttcaagcccttgaacttgaccattttgctgaaatggataccgttcactcatcacaggactcaaagcgtgtcatcctgacattcttcttaacccgtgaaaaactgtttcttgcattcattatgaacagatgcaccaaaggtgccgtaaaacttgtttttaacaagttggaacaccagcttggcacatatgattttttaaccttattcaacacgattcttacggatcgcggatccgaattcggagatccggagtctctcgaaaacggcattaatggcattatgcggtcaagcatctattactgtgatccgatgagaagcggtcaaaaaggcggcatcgaacaggcacataccatgcttcgaatgattcttcctaaaaagaccagctttgaatatctcacccagtgggatttaagaactatcgtagaccacataaattcaaccccaagagaaagccttggtggtcgaacaccgtatgatgtagcacttgaaaactatggtatagacatcttaaaagcacttcagcttaggccgattccacccgatgaggtcaatctgacgcctaagctgatacgctttaaccactaacttagcataaaaatctgctgtcaggctggaacttaacaattcacattttttgaatgcggcctgtggaatttagtttcgcacagaaactatccagaggcttgtttgccatgcctgaaagtaagatgttttatggaaagttaatctaattatagcagttttataaggatttagcctcccacaattctaaaaaatcaaagaattttaaagcggtggatttaaaatcatcacaaaatttgccataattatagatgatagatgccagcattttactacagtatcggcgctagatactataaatgcgagcgttttactataactatggaggtttcctgtatgaaaacgcaaagacgcacagcagacgaacgatatcaacttatcatggaatgccgcagcagcggtcttagtgactaccaatggtgtacagaacataacatcaatcccggcaccttttacaactgggttaaaagactgagaaaaaaagcttgttatgatatcccctctgccacaggacgcggcgattataagccagcccttaaaccggatgttgtaaaacttgaggtgatacctgatcatcaaaacccgggcattccaactgtcgaaagcacaatgcttccgctggaagaaccctgccccgccatcgaggtcatgcttgggactgtttcaataaaaatttcaaatgatgttgacccgaagctgctgtcacagatccttaaagctgtgacagggacatgttaggagacatcactgttgcagacgagatttatgtgatctgtggttatacagatatgcgcaagtccattgatggattatgcgctgtcgtaaaagaccagctgaatatgaacccttccaggccaaatgcaatctatctcttctgtggcagacgtagtgatcgaataaaagtgcttcttcatgaacgtgaaggatttgtacttttatataagcggcttgatgccaacgtaggaaaataccgttggccgcgcaaccgtaatgaggtaaaacccattacatggaggcagtttggctggcttatgtcaggtcttgaaaccgagcagccaaaggcgataaaaagtaccggaaatgcttgatttttcaggatttttcgcttgttttatggtataattgaaccatagaaaaggggcgaaaaaacaatgccttcaggagtaagagatatccagctcttagagcttaaggatacgatttcacaactgaataatacaatcagcactcagaacgggcttatccgttccctacagaaaatgctgcaggaacgtgatgccaaagacagcgaaaaggatcaactgatcgctaaccttcaggcacagttggactacctgaagaccagattttttggctccaccagtgagatccggcatgaacagctcccgggacagttggatctgttccacctgcagacggaggatgaaccggaaccggtgccccttgaggtggaatacattgaggtaaaagcacacaagaaggcccgtaaatcgaaagctgcttatgatgaggtctttgctgatcttccgacagagaatgtttatgtagatactcttacggaagaacagaaaacgtgtgatgtttgtggaacaatgatgattcctatcggacacgaacccatccggacagaactgcgttatacagagccaaagctggagcgtattgattattatgcgactacctatgagtgtccacaatgcaaggaaacggaagacccccggttcatcaaggacgaaggaactcctgcactgatcccggggagttatgcatcgtccggtcttgcagcacatgtgatatattataaatatgtcatgtccatgcccttataccgtcaggacagaccgtagacaaagtgctccgagaaacttccgtttctcggagcatttttctttgtgtttatgaaatttattccgaaaacaggaaattttcccttggattatgccatccgtaatccccattcctgcttgcattttgcaagcttttttaaattcatgcacgcaaacgtaagcgcgactttcattgtcatccgcgctttgccatacaactgcgtatatcgaaatccgtggttttcctttgccgttccaaagattctttcaatcgtttcttttctgtgtgagtatagctccttcattccttctgtatgccggatatcctcacatgtttccatatagtcttcccatacatgtctcgtaacaacttttacatggttcttgctttctgtacactgcgaaagatactcgcacttttcgcaaatctgtccacagcttttatactcgcgatatccgtcccgatttgtcgtgctgtaatgcagaaagtgattccctggacaaatataagcatcattatactcatcatatacatactcagatttcctgaaaaagccatcctttgtcatgggacgcttgtaaggaaagaccggctttattccatcatccaaaagtagctttgctattgcaggagttttatacccggcatcaacgatacagtatttcatgccgatatctgcaagcttatcgtaaaggcctttaaaagttcgactgtcatgctcattaccagggtttactgtaaaatcaataatccatccatttttatcgcatgctgtttcaatcccataagcaaacacatgcttgtgctcgcctttccgaaaccagccgctctcaggatctgtagtgctacacttaattgttttttcatctgacggaacatcatccgtataatcttcaaacttgtcgttgccaccggaaccaggtttgttgttatcgtctttatctttcaacggtttctttccgtgcgcttctctgtctgcgttaatgtcctgacgcagcatgtcagcataaaataaagcttcctgttttgcgattcgtttctgcatctttctgttgttcgcccgcgctttcacatgtgttgcatcaacaaaaatctctgttgaatcaaccagtttgaaacggtaacactcctcaaggatacgctggaaaatctgctcgaataagtcggtatctttaaaacgacgggtatagtttttcccgaaagtagaaaaatgagggaccggatcataaagttcaagtccaaggaaccaacggtaagccatgtttacttcaatctctttgattgtctgccgcatgcttttgattccatacaggtattgaataagcggtatcttaataagcgtaaccggatcaatacttggtctacccattccgtcggaataagtatcacggacgagatcatagatgaatgtccagtcaatagctttgtcaataagtcgtagaagatgattccgcggaacaagatcatcaatacataccatctgcatttgctttcttactttttctgtttcttgtgtcatcatagaacaataccgccttttttgatacctttattataccaaaaagagactgaaaagtcttgaaaatactgacttttagcctctttaatacagaaaaatccgtcatggtctgctccaaatcatacaggggacgctacgcttcccctgcgctggctgtcgccagctacccttttgtggacttgccatctggggacaccttgcgttgcaagttgttcccagccgacaagttttacaaaatctctctatactttgacggtcgaataaagtataatgaagtcaacgactaatcggaagttcaatgtgaggaaaattagatgaagaaaaagtcttattggttaagtattagtgtgttcgtattgatactgatatggacggtttattattatgcaatgcagtacacaggaggatttgcagacttaaaggactctattgtttgtgggattgtaggtttgatatgtatcgtatttatcgtgaaaagaactattgactttttgaaaaacaaaaaatcgtaaaattcaagtttgccacccacacatcgggtcaacttgtcccgaacttttacagctaaatatccgccgccttcacagcggcacaccgagcaggaaatctgaaaaaggtctcctgctttttttctgccaaaatgaggtggtaaaacgccaccccatccaccaattaccgaaaggagggacacgaaatgccctgtccacacaacgaaatctcgattgtgcagcgaagccaacagcagtctgcggttgccgccgctgcctaccagagcggcgaaaagctgttctgtggatacgatcaggaagtgaagcactacccggaaaagcgtggtatcgtccacaatgaaatcttgcttccggcaaatgccccacggtcgtatgcagaccgcaatactttatggaacgccgccgaagcggtggagaagcaatggaattcccagcttgcaaggcggtgggtgcttaccatccccagagagataccgcccgaccagtacgccgcccttgtccgggatttctgcaatcagcagtttgtttccaaaggaatgtgcgtggattttgccatccatgacaaaggggacggaaaccctcacgctcatgtcatgctgactatgcgggcaatggatgaacatgggaaatggcttcccaagagccgcaaggtttatgaccttgacgagaacggggaacggataaaacttccgtccggcagatggaaaagtcacaaggaagatacggttgactggaacgaccgcaagtattgtgaaatctggcggcatgaatgggagatcatccagaaccgctatctggaagccaacaaccgcccggagcgggtggatctccgttcttatgaaagacaggggcttgatattatccctaccgtccatgagggtgctgctgtccggcagatggaaaagcgagggattcagaccaacatcggaaatctgaaccgggaaatcaaagccgccaacagcctgatgaagtctatccggcagcttattaaaaatctcaaaggctggattatcgagcttagtgaaaaacgaaaagaactgcttgcccaaaaagctgcggaggaagcggtatttcttcccaatctgttgatgaagtacatggaggtacgaaaggcagaacggagcgactggacacgggcgggacaaagccgggggacttccaaagacttaaaggcagtcagcgaaaaatatccaaaacttccagttgtgctggtgacggcatacatgaattacgcactggatggatataaggtgaaagcaagccgatttctgctgaaagataaccttgcagacaccatagaagaatgtatggatgatttgatagcagaaattaataaaaaccgtaggattctcgaatttcgttttgtggagggaacgataaaactttatgcagatgacatcatttatatagaaacagaacttcacaaaaatgtattttatactgaaaaaggtacgtttcagatttataaaaaactggatgaactggaaaatgaattcaaggatatgggatttgtgcgggcgcatttaagttttcttgtaaatatgaggtacattacaaagatcagcggatatgtgatgacacttaccacgggaaaaaagattccggttcccaaggcacgatatgcacaggtgaagagggaatatatgctgtataaaggagaagaataatatgacattctgggtattggtatttattgcggaaatgctggaagtaaaaggaacgctatacttttttgatacttttatggaaaaaagagatggcggatataggaacagatacagattttttgtttattgcggagtgctttatctggcagcagtcacagggatatggatcggaatgttaaaatgtatcctgattatactggttatgtctttcctgaatctggcttattatgaggtctccttccggcagagttttttattttcaatcatcaactatacaatgcttgtattgattgattatgtgactgttttgctgggaagaggaggttcaatccaagaaaaatggtttttacaggcactgatatcaaagacggcttttatcattctgatgttgtttatcagaagatttagcaagacaagaaaaagctgcggtctgattacaggaaaagaatggttacagtttttctgtgttcctgtatttacggtggtcggtttcattcttatgttttattcagaaaacgatgatatgcagaatgtatttttatttctttcggtgggactggttgtgattaaccttatccttatggagttcatgcagaataccattgaaaaagaagagagaataaaaattgcggtacttacggaacaaaatcagaaaaatcgtattgcagattatcaggatcgggaagaaatctatgagcgtcagcgaagaaaaatgcacgattataaaaatcagctttccacgatccagacattgataaagaatggacacacagatgaggcactttcctttacgcagaagctgacagagagcatagctgtcgagatgtcggcaatcaacacaaatcatccagtggtgaatgctattttaaaccagaaataccgcagtatgcaggaaaaacacatagcagtgatcctaaaagtaggggatttgcaggagatctgtctggaggaggaagagattgtgattctgctctctaatttattggataatgcaatccgggagagtgaaaaggtactgaaaaataccggaaaagcggtcattcatctgaaattagagtgcgaagatcataaactgatatttggtcggcaacgaagtccggcaacgggcttcaaaagaccttgcaaacaatctcaatctggcggtggttactatttatacttttcttttatttttctgttgttttggttgtcatagggggaaaaagcccggaaataagggtttttccccggcaaccggctcggcaacgggatagcaacgaagtcggcaacgggctgtcattttcagaatggaagctccatctgctccgtgacctccacaaaaccgtccatagatttttcgggcgggttgtcggtgtccgttgccgggatttcacgctcccagcccttttgtctgccatattccgcaaacattcttggattggaaaagtagttccacccggtaatgcactggttcattatctcgttgatttcccggatttcccattgcttcggctcatcaaaggtgtggtttaaggcttccttgtagagctgcttggagcagaccgtttccccggtgtacttatcaaggtaagcctgtatcatcccggctttggtgtcctccggcataaaatcccgctggtgttctttgagataccgctgcatggctgggctgaatgacagcttgtacctgccgcttcggtaaatctccattgcttccgcccacatctggctgatataggctctggaagcggcttcgtcctccaaaatgtgaacctcggcttgctccgggtacaccatgaccgggataaatcggcggttgccggaacggtcaagggggagaaagtcaagggcgttggaagtaccgccgaacacgcactgacggggacggtctgccgggtgggtttcatagggtatcttataaacctctttctgtcggcttagaaaagacttgatttcctcaatgctcttggcattggcggttgccatcatttccgacatttcaattatccagtgaccttgcagcttgcggtacacgttatcatcgtccagcttccgcaaatcatcggaaaaccactcgtcccggactgccagcagacggaagaaggtggacttgccagccccctgaccgcctaccagacacagcatgatttcaaacttgcttccgggcttaaatgcccttgtaatcgcccccaaaagaaacagctttagggcttcataggtgtaatcgtccacatccgcccccagaaagtgccgcagacagaagcggatgcgctccgtcccgtcccatgcaaggctgttcagaaaatcccggatggggtggtacttattctcattcgccacaatcccgatggcggtttcaatctttttctcactggtcagcccgtaggtttcctccagatagagaagcagatacttcatgtccgtatcggtcagggctgtgctttctctgtgaaaaccgatgggctttatgatgtcctttcggtcggtcaggatgttataggcgattgccccggcaagcaccgggtcacgctggaatacggtcaggcagttccgtatgctctggcggacaccgcctttctcggtggtttccagagttgcctttacttcctcaacgctctggggcggctgcatggcgttcatggtgttttttagttcttgctgcgtctgcggcgtgcgtaattcatgtatgccgtcaccagcacaaccggaagttttggatatttttctttaatcctcatagctgttttcagcccatccatcccctgcatattgatgtccagaaataatagctgacacgcttccaaagccgattgttcttcgcataactgttctccagaatcatattctgtaatagcaaactcataattctttttttcaccatagtctgacagcaaatctgacagattttttctgtcatctatcctgtcatcacaaataataatgttcatatttttcattcctgtctttaattgctctcatgcctataaaccatacaagtctcacctagcactctttattatatcaaacaaatcttccgctcgatcattctctgcatcaaatgactattttccgcatagaacgactatctcctatagaaacgcagaagcactgtatctcaaactctttgaaatacaatgcttccctgcattttctatatcgtcatgttgatattattactttactatcctgcacactctctgggagtgactgtatctatcaaaaaagaagccagcagtttattcacgcactactgacttcctatattattcattttatttacttcgctgtgtctcagacaagttttccatctttaaacacaacctcttgccctccaggtatccgtcctctctcttatctgcaccgattacctttgcgatggactgcgccaccgaaggtttctcggcaattactaattttatattttttcactcaaattttgtttccttctttcattttttatttgctttttgatagcataaatgctatcatgtatatagaataaatatttccacttggagaacatatactaatgtacaacattgaattttaggaagattccaatggcagatcagagctttgggaatttcttgaatctcttcgagtcaaagcagctacaaacaaagatgcccgtattcaatacaagcagataagtttgtacatccagctcctcgaagataatggtacacggcttaatgaaaatatcacaaaacaccttgatgatgatatctgggagcttcgcccaggcaataaccgtgttttatatttttatttcaaaaatgatacctttgtgcttttgcatcaattccgcaagaaaactcaaaaaactcccaagcgcgaaattgaacgggcaaaggctgaacgtgatgattaccttgcccgaaaggaggctgaatgattatgaaaacctggaatgactataaggaacatgtaagaaccgttgatcctgaaattggaaaagacatcgatgaagttgaaaatatttcctccatcgtaagtgccatggtggaacagcgtacttctcttggacttagccagagagagcttgctgctatgtgtggtattccacaatcatccgtagcacggatcgaatcctgcaaaacaaccccgaatctcggaacactgcttaatatttttcagcatctcggtttacagcttacagtaagacctacaaaacctaccgtttaaaatcaaggagaatctctgcgaagaggttctccttatccggagtatttcaaatgaatggtaggtggtcggacaatcccatagtactatagaaatcgggcaatgccgatggagggaaggggattgcatagtaaaggtcttactgaggacacattatccgtactcagggacggaggaaataatggaaacgaaattagtgagaatagctgagatatcggcaacatcaaaacatcctatatttacatcagtgtaccacttgataaatgaagatatgctaaagcaatgccataaggaattagatgggaacaaagcagtcggaattgacaaggtaactaaggatgagtatgggaagaaccttgatagaaatatcaaggaactggtacagaggttgaaaaacaaatcctttaagccacttccgtcactgagggtatatatacctaaaggaaatggaaagaagcgaccattagggattgcttcctatgaagataagattgtacaaatggcagtgaagaaaatactgggagctatttatgaaccgagattcctaaactgcatgtatggattcagaccgaatagggggtgccacgaagcaataaaagaagtataccaacggataagctatggaaaaatcagctatatcgtagatgccgatatcaaaggtttctttgaccatatcgaccatgattggatgatgaagttccttgaatggaatatacaggataagaacttattgtggctaatacgtaaataccttaaagcaggaataatggagcaaggaaaattcgagccaacagaggaaggttcggcacaaggctcagtaatgagtccgatgcttgcaaatatatacatgcatcatgtgctgacgctgtggtttaagctggtggtgcaaagggaaatgcagggagagtgttttctcgtcaactttgcggatgattttgttgcaggatttcaatataagtcagaagctgaaagatactataaagagttaaaggaacgaatggaaaagtttggactggagctggaaagtagtaaaagcagactgattgaatttgggagatttgcagagcagaatcgtagagcaagaggagaatgtaagcctgaaacatttgattttctgggatttaccttctactgtagcaaaactcgaaagggaggtttcgtgccaaaggtacagacttcaagaaagaagtttgagctaaaggttagagcatacaagaactggatttacgataatcgaaatcgaccaatgcgagaaataattaaagagttgaacgtaaaactaattggacactatcgatattatggtgttacatggaattttcggaagataacaacattcctgcatagagtacaacagtttctattcaaagccatgaatcggagaggttgtagacgggcatacacatggaatggatttgtggaaatgctcaagtattacccattagcaaaacctaaaacgtactattgtttatattgaagcgaatgttactatgaggagccgtatgcgggaaagccgcacgtacggatctgtgaggggctaagattgagaggtcttagtctactcgacttgatggaacaatgcagatatgggtagatgcagaagattcattagaactatggtgattttttcaacagcactaaggttactttttcccaatctcatttattgagaatcgtctttttaccgtgcatatatattcaatatctttttatctattataatgaaatcaagggctggtctaatgccagccctacaaaaatgaaaattcacatagaaaataaatttacaatttttccgatataaacctgttatcaacaaatacaaacataatttatattatcgtatctattgatatgatatgtatttcaaagagttaccagaagtttttgaaaacttttcccttgtgatattatctaaagctcctaattttatacttttcccatgatggagcagcttatttgaccgtatctctagcaccaaagatgttgtattctatactgatacatcaatagaattgcgaactaacctattaccatttttgacaagcgtagattccactgattctcttgtaacgttatcaagaatgcttgtatcaaacttttgtcccggtttccaatttggattagccgatttcactgctgcatacatagcagctctatactgtccttcgtattgctctaaagtccatgtaccacttaaacgtttgtctttacttacgcttaactgataatccttaaaaatatctgaacgcttagttgtatcaccatttgaaagaccattttcctgaataaatttcttcttcacattatcaaacatcttttgacgatattcctcagatacacttgtgagttgctgccacgatgtacctttgctggtaacatccattcctgctactccatttgcattcagcaaatcaccttctgaatcaaattgcttcatcagattcttaataatggtatctcttccaccgaatgtttcatatatcattctttcttctggtgacatcatggcttcattttgcataataccagataaccagcctttttctttcaaagccttatattgtttgctatttgtattgatgccattatacgtgttacctaatccgctgatattcattgccatataaaaacctccttgtaaataaattcaaaatccgtttagaattaactcaatgttatatggtatatatcgtcataaatctccaagaaataaatttcaccgttaagtgccctcacaattatacaggtaactcacaatcctttagccaaaatcgcagttccataacagtcacagcaattttatattttacttcgatttcaactttttctggcggattggctaaaagcctgtcaatatcctgttcctcaacatcagccatttttgctatcgttagcttggatatgccatgataggaaacaagcacttccaaaaaaccgcttaattgcttatccttatcttcaatcgctccaaaatacagaaatcctacttctatttaaaattctgaattatgaactcaattccgttaccagtgaagaatatctttttgtccggttctttatagttactgttcagaggtaaacttgtaacaaaagaaccgatggtatagactaatcgtagtcaaaaccatcggttttcttatgcaaatatttctgcaatctcgcggaacagattggcctgctcttttctgcgcatcaaaaccagcatgctcatgcatttacagagatggtcgatgcttgacggactccggaatgacacagcctgcgcctgttttcttttatattttctcagcagccgttcggcttcgttattcgtggcaggtacattcttattatggaggaaaagaagatgatctttcttatactttttcatccttttgtacaggttgtatccatcacggtagtatttcccaggcggctcatagtcgtattcatccccagctatggacaggattgttttataacgttcttcaaattcggaaacggtctgcggatctggctcttctgattcagataaaccattccggtaatggatcatttcctgtatcagggaatgcatctgcctgttccatgtacggtctttttccttgtccatgctgtctttcagataacgcagtacatgtgcaaggcattcctggtggccggttccatacttataaaaggttacatcatgatcgtggaccagtgtcccctgatagtcttcaacgaccgtgccctttattccatcgtgtccctttttgtcccgggcaaaatagagcacaccgccatccggaaccgcacatacaaatacatacgaactttccccgtttacacgggcattggtacagtctgtatgcatgacaggggaaagcagcatgtcacggaaaagctctttgcgctgggattctgttttttctgcaaatgactggcagagattattgatcatgccttttgatatgtttatttttccatctgtcagatcagacaaaaacctgcggcttttatcaattgatgtacagcagccattattcagcagaaacaggaaagcacgtaaatttcctccatagttaacgtcatcaatgactccctgtggaaatggtgcatggatccgttcacctgttttggaattatagtacacatcggcatgatactcggtcacatgcacttctacgctgatgtcgattttctgctttgtaatggttttcgatgttttcttaaagtcagggtcatggagtacttcttcgggtgcaggaagatagatttcccttgtcggggtgagtttctttctgcagtgccccctgtgtcctggctgtccaccgggtttccttcctgtcttttcgcggctgttggatatttttttgcgggcgatagattttgaagacgggatggatgagttttcatagttccggttaatctgtgccgtcagtttctgtactttttgtttttcatcatcaagctctgtctttactttgtaaagttcccgtctctggtttgcaagaagtgggaattgatatttcagattccacgttttccataaaaattggggcggatggtcaggtaagtgtcgatggcattaatgataatgcaatgaaacagaagatagaggatgttttgtcaaagtattcggatgatctgatggatatttatttttctatggattcggaaatacaggcattgtccgataaagaaaagtatctgttacaagctgcggtggatgtggaaaaatttttatataaggcaactggcggcagtgcatcgcttggagacctttccgtggaaaatgcaacgatacatggtctgccgaaaacactggatgacctgttaaataatccgggcgataacctgacctatcaggattatgcaagcgatatccgggaaattttagcatataaccggacacagcacaaagatattatgtctgggttaaatgtacagtttgttatagcagacggtacatttcagataaaagattaaagtttataatggagtattcaataaaacccaagtgattgggagggagaatcatgagaatagagaatggttacttacaacaaagtatgttatgcagtaaaaataatagaaatgcagtaggaaatttttctgatacaatgaataaagcccaagagtgtataagtaataagattagcacaagggattcctatgtaaacagtacagattatagtaactttggaatttatacacaaaatagtatctctcaagatattgaattaccaatagagacagaaagatataaaattgaagatgctacatatgtgaatggagttcctgattaatatggatcagccattttcgtataatgtaaccatgacaagtgaactgaaaaatcttttgaatgatttgtctgacaaaagaaatattgatataaaggagataccgctacaggggggattggtagtaaaacgtgatccaaagacagggttaaattatttgtcgataaagggaaatgaggcacaaggagtttcggtaatcataacatccgataaagatatagagacgctgaataaattagctgatgaatttcaaaaatatccggtaagttcacagcggtttacggcaggattatatgctttacttgagatatcaggaaatctgaaacgcgaaaaagatggttttacatttttgactcctaatggagttacatatattccgtatgatggtgattccagcaaagaatgggaaattgatatgccgggttcctgttatgctactgccagaaaatgtttggcggcaggaaatgattgtgcagacataagtgcatggacaaaaaatttgaaaggaataaagatatatatacaagtatgaaactataaaaatatagtatgttttatgtggtaaataatagatcacttggaccgttatggagagtgaatagattccgaatgacagaggaaaggacagcatatctgcaacaggaaaaagaattttatacagtgttggcatccaaaataggagaataattttatgcatgatgcaaaaatgatattgagataggaggagttccatatgaaattagggaagaaaacaaagactgaaaaaggaacatttatggcatatgcttcttgttcatgtacttgcttctgcgtatgtaagtgccagaactgtaatagatcattggggagaagaaaatagaaatggaaataaacaatactggttctacatatggggcagcatttcgtcaaaaaccgatttttttcatgtctggaaaggaaacagtggcattttttgaaggaaaactgaagaaaaatatgacacttcaggaagattcctgtacacttggcagcaatgacacttatcgcagacagcataccacttatgaggtttcggacaagaagaagggaagtacgtttctggatctggattttctgattaaggacgaaaccagcagtctgaaaggaaatctcagtgataaaaaggatgtggatttctacaacttttccattccatttaatcgaaccatacagaattattttggggttcaaatatacatggacatgccggaaggctgtaattatgacctcaccttatatgatgaatatggcaatcaggtcggaaaggcagaatgggacggggaaggacgtaaaacactgaccatcccgaactgggatacaaataccaataaatattgtatcaaaatagaaaacaaaaatggggaagaagtttctccgcatgattattataaaatcagtttcaaggttacggaaaataaagaacaggaaaagaccgatgccataagggaggcattcgggaaccttcacggtgcatacagccggaaagatgaaaattggagggaatacctcgacaaatataatgaagtcctgatggatacagagaaaaattatacaaaagaaatggagaaattccaccagaagcagtttgaaagtctgccggaagaaaagaaatacaaaggcgggcgcacagtggatgaattgttgcaggacatggcggaaggaaagacactggatgatgcggaaatggagtatgtgaagatttttgccaatctgaaagattttgaaaaagcacagcagaaggcggaactgaaacatgatttttccgaggattttgtaaaggatctggaaagcaaaggtatctcccgtgatgagctggagggaatgcagataaagattgaaagcaatgggaatggtatctgcaatcagtttttaaatggtaaaacagatcaaaaattattttgtaatgaaatgaaagaccgtttaaatgattactatggaagcaggtatgaattaagaaatcagccagaagctgttgaaagcagagtaaataatatgttgagtaaattacaacatatgtatgcactttagaattatgatggagatatgcattgttttttatcctaatgtggatattttattagaattatttataaacctaaagatttaagaaacaaatgcggtgtaattacgaaatgaaaggtggattattatgaaaagaaaatttacaaaatggcataagaaggggcttggtgcagtttttgcatttgcagtaacattatgtacaggtttattggctagtggacagacagcatacgcctcaacaatatatacagatacagagtcgaacaattctcatgaagaagcacagattatttcgaaaaatgcacagactgcttctcaggctgtttcaggttcaacatctgtgtatcgttatgtaactgggactttgtcatatgatgatgaagattggtataaggtttatttatattcagatgatgaaaattatcttgatttaaatgttggttctggaacaatatttgtggatttgtataattcatcaaattttgaagtacctatggacagttttcagtttcaaaagtatggagatacaggcgtctatgaagtcagtgttccgtcagatggcttatattatttaagggtatatcatactataacaagtatttctgcaacatataattttactattggtaatccgaagtacacacttggaagttatacgcatacatttaaatctactacattggcggctaaaggaacatggcaggataaagttgatttaacgcttattacaagtataccagacggagcaataggatacaaaataagcattggtggttgtacatcatctgtaagttcaaagagatacttttataatgaattttatgatcaatgggtagcaacaaagtcgacttattcatatagtctgccagttacaaattcttcgttgctggatcaagtatggggtgccaagatagtatctaccagttcgtccagcaagacattttctccgacaatgacaattaggtatgttgcacctgatttgccatgaaaatatatatttgaattataaaacttttagtgtatcaggggaatatttattatagttgatatactaagaacataatgacacggaaagtataatgttgaaaaagggtttggagaataattatgaagacagtaacagatgtaaacatgatttcattggtctgccccggacgctggcgggatttcagcttgttctgcacaatatcaaagctcatgcggtcaatcagcggttcgtgctgtccctcaaccacaacccagtcctccggtttcttttccccaatcgtgccgattttgaagcggtagtcttttttctgggaagcaatcgccccggtgtagacgggattcatcaaaaggtctttgataacggagaagtcccacatataccgcccgttttccgggtctttcttttcccatttggtgcgggtattgcgaagcccccgttcccggttccaccatgtggggcaggggattttttcttcctccagccgtctgcggatatagttcggaccatgaccgtttagggcatatccgaaaatcagccgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcgttcaggatattcttgaacggggcaatgtcgttgttatcccgtaaggtgtcgataccgtcattcatggcgatatagcgcaccccgtttcttgggaaaaagtcctcaatcaaatgcccggtttgcagatagttacgccccagtcggctgaggtctttcgtgataacaaggttgatttgcctgcgctcaatggatctcaacattctctgtaaatcaggacgctccatattaagacctgtgaagccatcgtcctgatagactgccacaacctcccatccctgcttttcgcagtatttttccagcatatcacgctggtttgcgatactggcactttcgccttgcaggtcatcgtcctttgacagtctgcaatagaccgctgcacgatagcccccggcaagtgccgaaccgattgttctgtattccatttcgttcatcatagccatttacccacacaatccagacggtatccggctcttttgaacctcatcttcattatacttcaattctttctttttagcaagatattcttttgtatttgtcttgccgtatttctgggaaatcaggctgacgaacacatcggtggcgtccagctccccgtcaaatacagtggtcacatgaatctctgttttgttttttgccataggcagttatcctccatacatgaaaatagccagacagagggtgtcggcaacgaagtccggcaacgggcttcaaaagaccttgcaaacaatctcaatcactagtgtactggcatattgatatttagtcaattatttctggctgttattgccgttttatggtacaataaaagaaacggcggtgatatcctatggcaagaccaaaaaagtacaaaatcaaacttacggatgatgaattaaaagaattaaaatctgtcatccgaaaaaataaaacatccaaaacaatccgatgcagatgccagattattattgacttggatgagtcccacggaaaagtattgactcatgagcagtctgcaaaatcaaatggtgtatgtttggcaacagtaaccaatactgtgaaaaaatattttgagggtggtattgatgcagtaactgagtttaagcgtaatgttaattctgataatgcaaggcgtgtgctcgatggacgtgctgaagcccgtatcattgaacttgcctgtggtccggtgccgaaaggacattcaaggtggaccatccggctgctggaagagaaatcaaaaattgttcttgatactccggtcagccgtgaggcaatccgaagagccttaaaaaaaacaaacttcgacctcacaaaaacgactactggtgcatcccccaaaaagatgatgccgaatttatagcatgtatggaagatgtccttgatgtatatgaactcccatacaatcctgaaagaccagttgtatgcatggacgaaaagccttaccagttactgggcgatgcaaggaaaccactgcccatgcgtccgggtgacaatcagaaaacagattcggagtatgtcaggaatggtacctgcagcatatttgcttttgtcgaaccgcttggaggcactcatcatgtcagcgtgcgagaacatcgtactgcctttgactgggcagaagagataaaatatcttgttgatgtcatgtatcctgatgcagaaaaagtaattcttgttatggataaccttaacacccataaaacggcgtccttgtataaaaggtatccagcagatgaagcaagacgaattatcaagcgtttggaaattcactatacacccaaacatgggagctggcttgacattgcagaaatagaactgaatgtaatgaccagacagtgtttgtcacgaaggattgaaaacattgcaaaacttcgtgaagagttagctgcgtgggaagtcgagcgtaatacagtcgcagcaaaagttaattggcagttccgaactgccgatgcaagagtgaagttgagttcattatatcctaggtttacaacagcttccgaataggaagttgttgtaatgctaaaaatcagcgtgccagtacactagcaaagagcatctgccttacaagcagagggtcacaggttcgagccctgtaggtcccatttattcatatgccgatgtggctcaattggcagagcagctgatttgtaatcagcaggttatcggttcgagtccgatcatcggcttttatacaatttcatattgtatatatgggcagattcccgagtggccaaaggggacagactgtaaatctgctgcaaattgcttcggtggttcgaatccacctctgcccattggaattactttttcagtaattgcatataattaaatatattatcgcgggatggagcagtctggaagctcgccgggctcataacccggaggtcataggttcaaatcctattcccgcaactatgtgcctagttagctcagttggtagagcagaggactgaaaatcctcgtgtctctggttcgattccggaactaggcacttttaattgtatagagaacatattggtataattggaaacgacacatgtgtgcattactcactgattaacgaacaacacgcgtgtgtttttctatgctcaaatttatttatattaaaggagggcaaaattatgccaaagaagagtagactcgaaaatattttatttacacttgttatggcgtttgtcatggtgtatgccatggtatgctataacatcgcaatcgacaaaggcggaatgacaaacgaagtttttctgctggcgtttcatgaaataccgattatgtggccgatcgcatgtatcctggagtattttgtagtggagaaactggcaacgatgctggcgtttcgtctggtaaatccgaaagaagacaagccggtctttgtgacacttgcaatctgttctatgattgtatgtctgatgtgtccggtaatgagtctgattgccacagttttgtttgcacatccgggaaatcaggtgatcgcagtgtggctgcaaaaatttgcattaaacttcccaatggcattatgctggcagatcttttttggaggagtatttgtaagaaacttatttatatgggtgaaaaaagcgattcatcataaataaaaagagggtgcgcataatgcgcaccctctcagactgtagacaaagtcctcggctttttgccggggatttttctgtattaaagaggctaaaagtcagtattttcaagacttttcagtctctggacacgggcgggacaaagccgggggacttccaaagacttaaaggcagtcagcgaagccctgtcctatcttcagagaaagggactttccaccgtggaggatttggaaaactttatagaaacgtccgggaaatctgccgccgactaccgaaagcagatgaagccaaaggaaacccgcagcaacgtgattgacgctatccttgccgcccggacggactgtaaggaatgtaagcccgtttatgagaaataccagaagatatttttcaagaaaactaaggaaaaattcaagctggaacacccggaggttgcccggtttgagaaagccagtgcctaccttgccaagcacccggatgataaggacagcacgaaaaaggagcttttgcaggaacaggcgaagcttgtgggcgaaatcgcagacttgaaagtaccgttgaccgaggtgcaggaagatttgaagaagctgtgggacatccgctactgggtacggaaagccacacccggcacagaggaaagcaaagagccgcccaagaagcagcccctcaaagaagtcttgcaggataaggctgacgagaagaaagcacagaaaaacgccccggcgcagacgaaacacaaacaacaggatatggaactttaacaggcacttgccattttcagattgagaatgataagtgccttttcttttttacaaggaggaattgatttgaatgtatttgaagctgtgaagcagtccgttacgacaagacaggctgcggagcattacggaatccgggtaaacagaaacgggatggcttgctgcccgttccacaacgataagacccccagcatgaagctggacaagcgtttccactgcttcggatgtggtgcagatggggatgtgattgattttgtagctgccctgtacgggctggggaagaaggaagccgccgcacagttggcgagtgacttcgggcttgcctatgaggactggaagccaccgggcagggcaaggaagcccaagccccggcagaaatccccggaagaacagttccgggaagcaaaggcacattgcttccgtgtccttgccgattatctacacctcttacgggtatggaaaaccgactatgccccgcactccccggaggaagcgtttcatccccggttcgtggaagcctaatatccctattataggtatccttcgcaaaacttaatgcccggtactctgtaatattgaattcgtaatagtccacatcctccgtatccgataaacttccctttaaatatccgtccggcttattgataagtgccgtcagatccagtattcttccaaacacatcctgatccgtatatttattggttttccagaaataatcattggaaactttactgttttctactgctatgttgttatcagtgggtaaaccttttttcttaaaatcatatcccaccagctgcgcatgcatctctactgtgcgggttattaccatcttttcattctccttgcgtacaattttccatatgtactatttgtcagattttcgtatcaagcgttgcctgtgcaggtgatttcccagactctgctgtttctcttgtaacactatctaatacgccatctttgattggcttaccaatttcccagttaggatcagccttttttgcggcatcataaaatgcctgtctgtaaattctctcatatttttcaagggtgtacccggcagccaatctgtcctttttctgcattttgcggtacaaattgttatatacctcggaacgttttgttgtatctccattgtggacaccgttttcacgcaggaactctttttttgtcagttcatacatttcttctttgctactatccggaattgatatgatcctttttctcgaactttcattttcatctgtcactaaaagtcctgccagtccatttacagggttgatataatctccatccttgtcataatgactcatcagattttttattccctgaatattgccatacattgcaccatttccagcagacatcatttgttttactgcggctttatattgtttgctgtttgtgttaatcccggcagcttttaacttggactgaacagaactgctgttcaactgggacaactgaaaactgcctattgcatttactcctgatgtcccaaatgatttttgaaacaaaaaagcataatccgttatttttgacataaaacatcctcccatattaaacctgttatcttacctatatccttacgctttcctatcaaaaggacggttgcaggtacacatttcttcccgtatcaacggaatagcccatatagatacccgtagtttcccctaactgctgtgtcgcaccaaaaccaagtcctgccaagaagtctgattttacatactgcacataatcattgatatatcgcttgctggctggaagaaattcagaatgaagccccagcatatccccagcaggacgcaccagctttacattgaggtcgtcgtaaaagtctttgacttcatcacaacggcgtttcagctcgtcaagatcgggtgcagacacccgtatcacgtagcttaacttatacatactttcttttgtctggtctaaatcggtttccagctcgtccacgctgtctaaagcgtccaccacatttgagctggtttcacttcctgcttgataagcgtgattgtcaaggtctttcaattcctttttcttatttcttactgtggtaagagcctttctgttctccacgatttctacattcatagaagtatcaacggggaatgtgaattgctgttgctggaaatagaagatttcacttgacggaaaatcaagctcgcctacaatcgcattgacggtaaaataggacacatagctttccttatcctcatgttccaatcgtaaataccgctggctttcttcaatcacacaccttgtcggacggataaggtcgtagtattttatcagcgtttctttgttcaatttcttctttggtagctggtactcataatcttcataagcgataccgtccctgccgtaaagatgttccatgagatacccaaaatcattgatttccaagcgacgcaccttaaagcgacgggagattttattttccagtaacttttccattttcatgtaacggttgatttcatcattcggcatggaaacaaagtcattcatcaacgtgtggttcacttcatggagaaattccgtgaatgtcagccacgccgattttttgatgttcttcagattgagctgttcttccgtaaccatgagcttaaagccaagaaaaaagcggtagtccacttgattgtccccaatcatagatactaacgcttcggtctgagctatcattgaagcagataatgaaatgcagagaataaaagacaaaattggtatgttacacgaaatttagggagaaaactgagcaagtaggaaggtggaagatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtgggatcttggttttgggattgtacgcatcaaataagacatcctctatgaaaatgccttgggttatattaattttaattttcccaattatgggtgtaggcctgtatttattgattggtttgaatggtggcacacataaaatgcgtgagcgatatgcagaaattgatagcaaattgttaccaatgctttccgataatcaggagtgtttaagcagaataaacgaaacgattccgaaggcaggaaatatagcaagttatatacaaagaaattcgcagtatccaatctatcagaatacggatattgtgtattttgatgaagcagtgaaaggattagaggcacagcttaaggatttggagaaagcacagaagtttatctttatggaatatcatgcgatagaagacgctgaagcatggcataagattcaagatgttctggaagagcgagtaaaagcaggtgtgaaagttagagtattctacgatgatatgggttctataggctttattaacacagattttgtgaaaaagatggaggcaataggaattcattgccgtgtattcaatccgtttgtgccaggtttaaatctgtttttgaataatcgtgatcatagaaaaataacagttattgatggaaaagtcggatttacaggtggatataatctagcaaacgaatattttaattacacacacccgtatggacagtggaaagatacaggtattcgtttagaaggagatgctgttcagtcgcttacggtgacatttttggaaatgtggaatgcagtaagtgataaggatgcaaacaacagaaaggacgtgaggaacaatgcaggaaacaagggtgctggtggaaacgaaaggaacaactggcgaagaaacaatatcatactggttcgacctgccgatagatgttgcagagtttgaagaaaagttaggtatcggtgcagaaagtggggattaccgcattatcgaaaaggtgttgccttatgctgatgaagttcacgaacatacaagcgtgtaccagctcaacgaattcgattttatgtaccgccagctttcaagcgatatgcaggaagaatatacagcacttcttgcggtgtatgaaaatttagaagcactttatatttgcaggaacgtgattacggtttatcccgactgcaaaagcatgatagatgttgcaaggcaaaagctgatgaatgacccgacgttcaaacatttatccgaggactgtcaagaatactattttgactttgaagcctatgcttctcacttgcaggaacacgggaaatttttagtaacggaacacggtatctttgaactgccagagtaggaaatgaggtggtgcttatgattgatgatatggcggtttacattgctaatcttggcaaatacaatgagggctatttagtcggtgcttggttcacgttccccattgacgaggaagatgtaaaagaaaaaatcggcttaaatgaacagtatgaggaatacgcaatccatgataccgacaacttcccgattgcgattggcgagtatgtttccattgaagaactcaatgatatgtatgaaatgatagaggaacttcccgactatatcgtagaatgtctggacgaatttatcagccactttgggacgctggaagaagtcgtggaacacaaggacgatatttattattatcccgactgtgaaaccatgacagatgttgcctactactacatagacgaattgcaggcactaggggatattccacccagcttgcagaactacattgactatgaagcctacgggcgagatttggatatgggcggttgcttcattgaaacaagccgaggtatgtgcgagataccataccgcacgtacggatctgtgaggggctaagattgagaggtcttagtctactcgactatagagttaaaaaatataagttaaggaggcatgtattatgaaaaaagtaatctatctgcttgtattatgtatggtactgggaatggctggatgtggaacgaatcaagaaaataaagaacctgtgtctggaaatgtgtccgtagaaacagagaataaagaaaatgatgatgtagtacaaaatgagcaaatagcagatactggctcatatcctccatgtgttatggttgatggtgttatatataaagacacaggatatgtagcgtcaatgcctggttgtggaacaatggatggagaaattgtgtcaacagtggcagggacagagttaccatctgaaaataatcaatcaaatttcggaagcggatatcattatcaaaggagttctgaaggtcagctcatagtagtcattgatgacgaacgaatcatatttagagatattgaaaaagatgatacgtctattccaatagaggttatcaattttaatgcaaaagtaaaagaaattaccgatgatggagaacttcttgtaacgcatgtgagtacagctgaaggcttttgtcagatgaatgatggagagtattatgtatcggcagaaaatttagcggaaaatgttcaggtgggagatatcgttacaatatggtttaatggaatgattcaagaaacataccctgctcaattgggggtagtttatagaatcattaaaacacaataattagtcaaattcttatttatggaggtatatattatgagagtaatcatttcaatcattcttatggtaattgcagcgttggtcggttttttctttggtgctggaatgaacgaagcaatgggtggagcaatactactttcaatgattacaggttttgcttgcactattaatgctattgaaaagaacaagaaggactgacaacttcaagtttgtaaaactgatggaataaaaaaatgtaaagctgggagcattagcttaatggaaagtttaagtgtattatggagccatatccgggtaatgaattagatttttaaaaagtatttcatgtaggagtcagagcatattactgactcctatgcagaaaggagaacaattttatgagtataacgaaagttggaagttcctataatttcatttataacacaaagacaggtaaattatctacaaaagatggcagcaaaaatgaatttgttgatttttgcaatggagatgtaaagggagaagatacagagacactgaatcattttgatgagcatacaagatatcagtttacaagaatgctgtttgcatatggaaccggaatgaccggacagaatccttttgccaatgatgagaaagtcgagattacagcggatatagacagtgcaacccatacttccttttatgtgaatgggcagaaagcgtttacggcaattacgggtatgtcatatctcccatccgagattcaaacctttggaaccgtacagcagccatttaaaaccagagggtacaaaccatatgatcccagtacaaacagtatcacgattggggttggaagcagatttaatcttggaaatggatacagcatgacggtacaggaagattttgtctggggcgagggctatggaaacggaagcaaggcagatgatgaaagatgcaatatgatgataggtggtctgaactccctgatacattttgcggatcagcagtatttttcaagtatgacagatacatacaccgattatattttagattttcttgcgtcacagggagtggatacaagcagagaatttgtgataaacggaacacattgcgaactggtaaatgggaaaatacgtgaagttggtaacgattatgtggtgcctagttccattcagcagaaagcagtgaaaagatatgaagaaagtatgtcacagcttttgaatggcggaacttggtatagatggtcataaaagtaatagatcacttggaccgttatggagagtgaatagattccgaatgacagaggaa
